United States Patent 7,745,391 (HUMAN THROMBOSPONDIN POLYPEPTIDE) - sequence listing, part 146

SEQ ID NO: 379789 - DNA, 1998 bp, Homo sapiens
ctgaggcagccgccctcgcgctgtgcaatttctggtctttcgttgcttctggtccaggctaataaagtttttctttctttaattttttttcttctagttttaacgggagaaattaactccccggggccgccgggttgactgcgctgcctgggccggaggtcttctccggccagggagcgctgtgggaaggggctcgagcggccagggccaggcgaggccgggggggcggggggttaggggaccgcggggctactcttgggagcgcccctgtccggctggctgcgcgccggttttaaatagcatctttcggacttgtcttcgcggccccagtccccgacctcggcgctgcctgggctcctgcagcctctccctaagtcttctccaaacgaccacctcacggattccttatggatcgcagctccaagaggaggcaggtgaagcctttggcagcttctctgctggaagctcttgattatgatagttcagatgacagtgattttaaagttggagatgcctcagattctgaagggagtggtaatggaagtgaagatgcttcaaaggacagtggagaaggttcctgtagtgattctgaagaaaatattttagaagaagaactgaatgaagatattaaagtaaaagaagaacaacttaaaaattctgcagaggaagaagtactatcatcagaaaaacaattaattaaaatggaaaagaaggaagaagaagaaaatggagaaagacctagaaagaaaagggagaaagagaaggaaaaagaaaaggaaaaggagaaagagaaggaaagagagaaggaaaaagaaaaagcaacagtatctgagaatgtggctgcttctgctgctgccaccacaccagccacaagtcctcctgctgttaacacatccccttctgttcccactacgacaaccgctacagaggaacaagtcagcgagccaaaaaaatggaaccttcgacgaaaccgaccacttctggattttgtgtccatggaagagctgaatgacatggatgactatgacagtgaggatgacaatgattggcgacctactgtagtaaagagaaaagggagatctgcatctcagaaagagggaagtgatggagacaatgaggatgatgaagatgagggaagcgggagtgatgaagacgagaatgatgaaggcaatgatgaagatcatagtagccctgccagtgaagggggttgcaagaagaagaagagtaaagttcttagcagaaacagtgctgatgatgaggaactgaccaatgatagcctgaccctatctcaaagcaagagtaatgaggactcgctgattcttgagaagagtcaaaactggagctctcaaaaaatggaccatattctgatttgctgtgtttgtctgggagataatagtgaggacgctgatgaaataattcagtgtgacaattgtggcattacagtccatgaagatgggttcatattgtttgtgccctgtatgttcctggagtagcctttggagatattgacaaattacgaccagtaacactaacggaaatgaactattccaaatatggtgccaaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggtaggtttatttaaacccatagttggtgaacatgttcacaagatatcttttgactctatgtcctataataagtgtaaataataaaagaaattttaacatttattcttaaagttcttgccaagatcactgttctaaaactttaagagtaaatgcctatgagttttgtcagttttaaagctagtcagacgttcagaaaacataatttttatagtgagatctgacagataaaatgaaagataatccaagttgtcttaaagcattaaaatgtcggcatttcagccccatgaattatagtt

SEQ ID NO: 379790 - DNA, 1724 bp, Homo sapiens
ctttcacaaaaggtgaaatgagctctttgtagtgtttcccgcccaggctgcattttagaatcacagaggaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379791 - DNA, 637 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtggtaagttcctacccggctcgtgggaaccatgggctcaccctgaccacgttgcttcctattctctgccgtccacggccccagtgcccaagttctgagcctgactcgggtaccagggtcaggggaagaagaag

SEQ ID NO: 379792 - DNA, 428 bp, Homo sapiens
atttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctcccagcaggcatgggaagagcactggtgtgggggttccaccgagaaggggacctcatctagaaaagaggttacaaacctaccattaaactatttttcctaaaacggaa

SEQ ID NO: 379793 - DNA, 2123 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaacaaaaaaaaaaaaaacgacacgtagcaacaaaactgtgttgggcgaggctgtggccctgaaaaagttttataacacaatcggtgtgggagcacggggcccccagtaggtatggggaacatggggccatacacgtggtccccaagagaaaccgtgggcacgggaacatgaggcgtggggagtttcccccagtaagaaaacggcccggggcggacaccgaggtgttcggggaaacaccccaaagggctccagaggggccaagagcagaccaacacagggggatccaaggagcccagataattagcc

SEQ ID NO: 379794 - DNA, 1766 bp, Homo sapiens
gtttggctggattgatgatggagaggcaggcagtgaccagaccaagagacgccttggatggtggagaataggtgaccctctgttgggtaaaagaggactcaagccctcacacagtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379795 - DNA, 1729 bp, Homo sapiens
aaggctcaggtgaaccagtttcatctgacctgcttgctaactcaaacatggctgcccaactgcgtgggctggcaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379796 - DNA, 1784 bp, Homo sapiens
gtttggctggattgatgatggagaggcaggcagtgaccagaccaagagacgccttggatggtggagaataggtgaccctctgttgggtaaaagaggactcaagccctcacacagtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaagctttcacctctgtgcagctactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379797 - DNA, 1723 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379798 - DNA, 1789 bp, Homo sapiens
tgctgtcctgctttaaaggagagggcagccaccatggctcacgcctgtaatcccagcgctttgggaggcagaggtgggtggatcgcttgagcccaggagttcgagatcagcctgggcaacgtggtgaaaccccatctctttaaaaaaatagagcgccacccccataaagggtcacacagttagtgcatgtcagagcacccaggtcttctgaatgaggtcaggttctccaaggaggagggcagaacacttcctttcctttgaatgagttgcttaacgcttttgtaagccttggttttctcatctgtaaaatggggctgatgataatagctacctccaagtgtttttgtgagactagatgagataatgttttatagtaggtaggtaaaatactaaacatagtgtctggcacatagtgtttaaaaagtaactgatatgatgatggctgtcattctgattgttagtcttatctctacaggccccaggcctcccccagatgtgtggagctgtaccatccagaatggtagccgctaggcacatgtggctatttacttatttatatttgtttatttttagagatgggggggtctcactatgttgcccaggctggagtgcagcagctcttcacaggtgcattcttagcgcacgacagcccaggagtcctgggctcaagcagtcctctgacctcggcctcctgagttgctggaactatgggcatatgcactactgcacccagcacatgtggcgatttaaatttacaatttaattaattaaaatttaataaaataaattcagttcctcagctgcactggccccatttgcgtgctcgttagctcgtggcttgtcttgttggacagcgcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379799 - DNA, 1573 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggatgcggaatttggtcagagccgttcatgtcagagctcagcagaatggcagctgaaccctgggagatcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgtcgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttc

SEQ ID NO: 379800 - DNA, 1901 bp, Homo sapiens
  misc_feature (99)..(100): n is a, c, g, or t
tcggatcctctccgctcccttggagtgagcaagcgggacagttctgcggaaagtttccgcccccaatcccctcagcctgcgcccggactgaagcggcgnnccccacctccagcatcctcgagcgatggtttctcccacaactaccccggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379801 - DNA, 1819 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379802 - DNA, 2317 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaaaaaaaaaaaacaaaaataaaataaagaaactcacaaacaaaaccacaaaaaacaaaccaaaaccatgacaatagcacaacaccacccacactctaataacaaatcctcatcaaaaacgctaacaacaaggcttcctacaactgtggaatcggtcagagcaactatgtggcattagacacattgatttggtcaccgttgaaaagactcaatacgcagcattgagctggttgggctgcatgcgcgaatgatctgtgaacgggaacgaagtagaaaaggctccggactgcgcccgccgggaacggccataggcgctctggggtgctggccctggcgatggacagacccagtggttcggaaggggacggtgcgtgtggcgcggtgagagaccggaccagacctcgagcgactccagagtggtggtttggaaataccagaggtccgaccctggagttgcacggcgaggaagactgggcgatgataagaagcacgaggcggcgc

SEQ ID NO: 379803 - DNA, 1781 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379804 - DNA, 1833 bp, Homo sapiens
cgcttcctggggcttggtcctggggtttcatctcaggttgacccccgttaggaggaagtaagtaggaaggaaggagatttcctgggtattagggtgtcctcaagcctgcagctctcctgggactgcacagagtttactgtcggacatcagttctgatatggtgcagcagacatggagctggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379805 - DNA, 1927 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagatggagaacgtttccgtgactgcaggaagttccactgcagagcgctggcagagatgatggtgggaggagcagggctcccactaacaccctcctgcccctgttcctcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgttgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaa

SEQ ID NO: 379806 - DNA, 1669 bp, Homo sapiens
gcctcccctgcaggcggactcgcccgctcccaggccggacccgcgcccgggacagggacccggccgagtcgagccgtcgcgccagcgctgcgccgccggtcggtgcgcctagcggatcggagctgcgcgcggaaccgtgctgccccgccccgctccacccgtgagggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacaggtacatcgagcttttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcaggatgcggaatttggtcagagccgttcatgtcagagctcagcagaatggcagctgaaccctgggagatcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgtcgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttc

SEQ ID NO: 379807 - DNA, 161 bp, Homo sapiens
cagtcgttataggtagcttctttcaaactatacccctgtccactctgaagtattcatattgctatgcagaatttgcttttagatcactctgttctccaactggcatctatgtctctttcatttcacgcacctattttatcttttactaaaagctgacacca

SEQ ID NO: 379808 - DNA, 1733 bp, Homo sapiens
cggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 379809 - DNA, 365 bp, Homo sapiens
gataatccagaatatggatattaatgtttttaattacaaatgaaaacaaaaatatgtaagtcttatggaaacttcttggaccttgtagaatgtatctttggccccattttgagaaatactggcctactgccataagaatttgacttttgatgagattcgatgaggaattcatgctgtacatttgctaaatcatccaatagggggagacattcttcagcttcttaggtttttcattagtatgacttcagtcccttgaggtcacagattttcatccataggatggtttgggaaacttctgttatcatttaaggcactaaaggttctttctcgtgtggctccagtggggggcgacggggaggagacag

SEQ ID NO: 379810 - DNA, 489 bp, Homo sapiens
gataatccagaatatggatattaatgtttttaattacaaatgaaaacaaaaatatgtaagtcttatggaaacttcttggaccttgtagaatgtatctttggccccattttgagaaatactggcctactgccataagaatttgacttttgatgagattcgatgaggaattcatgctgtacatttgctaaatcatccaatagggggagacattcttcagcttcttaggtttttcattagtatgacttcagtcccttgaggtcacagattttcatccataggatggtttgggaaacttctgttatcatttaaggcacctgtggaaggacatggcggggcgaggcacagccagtgcattcctgcctgcgaacaggccctcccagcagctttgccgcctctccatcgtcttgggcccttgctcaaatagctgtgggtataggctgcttttcttcgaaatatccacaattcagatctcagtcacaagagtcgccg

SEQ ID NO: 379811 - DNA, 1980 bp, Homo sapiens
cggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcagacaagcgtgatctttttcatgggtgatgagtgggtacatagatggctgcacacagttctcagggaagagacccacaggctccagcgggcaggtgggtgggacgcttgctgaagtgcagttccccagacccagagctgaattcactgaatctgcagtatgatgcagagacctgcttccatgacagataccccaggtgactcggatgctggcggactgggaccatcccttaagaaagtgttttttggg

SEQ ID NO: 379812 - DNA, 1482 bp, Homo sapiens
ccacgccacccctcctcccccccgcccacccccccccccccccgccgactatcgctatggtatgagtcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 379813 - DNA, 948 bp, Homo sapiens
tcataggttcgcaggagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 379814 - DNA, 828 bp, Homo sapiens
gataatccagaatatggatattaatgtttttaattacaaatgaaaacaaaaatatgtaagtcttatggaaacttcttggaccttgtagaatgtatctttggccccattttgagaaatactggcctactgccataagaatttgacttttgatgagattcgatgaggaattcatgctgtacatttgctaaatcatccaatagggggagacattcttcagcttcttaggtttttcattagtatgacttcagtcccttgaggtcacagattttcatccataggatggtttgggaaacttctgttatcatttaaggcacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 379815 - DNA, 1379 bp, Homo sapiens
cggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttg

SEQ ID NO: 379816 - DNA, 1679 bp, Homo sapiens
cggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccgggcctgtttcctggaagtctttagcaatcacatttgctattggaggagctttactggctggaatgaagcacgtcaagaaagaaaaggcagagaagttagagaaggaacggcagcgacacatcggcaagcctttacttgggggaccgttttccctcacaactcatactggggagcctcattgccctgatgtctgtccagaagaactagaaaagatgattcaagtcgtggatgaaatagatagcattacaactctgccagatctaactccacttttcatcagcattgacccagagagggacacaaaagaagccatcgcaaattatgtgaaagaattttctcccaaactggttggcttgactggcacgagagaagaggtcgatcaagtggccagagcatacagagtgtattacagccctggccccaaggacgaagatgaagactacatagtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttca

SEQ ID NO: 379817 - DNA, 947 bp, Homo sapiens
tctaggaaatgcaagttctgcagtgcgcagctggaggcaacgtgaacgtggagatgaacgcagcccccggggtggacctcacagttctgctgaacaacatgcgagctgagtacgaagcccttgcagagcagaaccgcagggacgcggaggcctggttcaacgagaagagcgcctccctgcagcagcagatctctgaggatgtcggagccacaacctcagcccggaatgagctgactgaaatgaagcgcactcttcaaaccctggaaattgaacttcagtctctcctagccacgaaacactccctggagtgctccttgacagagaccgagagcaactactgtgcgcagctggcgcagatccaggctcagatcggggccctggaggagcagctgcaccaggtcagaaccgagaccgagggccagaagctggagtatgagcagctcctggacatcaagctccacctggaaaaagaaattgagacctactgtctccttataggaggagatgatggagcctgtaagtctgggggttacaagtctaaagattatggatctggaaatgtgggaagtcaagtcaaagacccagccaaagccatagtggttaagaaagttcttgaggaggtagaccaacgcagcaaaatacttaccaccaggctccactccctggaagagaaatctcaaagcaattaatttgagatgcaacagagaacgtatgccacatagcccctgcgaagaaaaggcattatgtatctgtccagaaaaatgtgcatgtctaagaaaaatgtctaacctgttgtctttctgttactttctttctgggcaatcaatgacagcatctccccattcatctagaagaatgccacacacaaatatgactcatttgattatcctacagaaatctgttgtcaattctttgtattcaataaacctcttctttagcaagttaaa

SEQ ID NO: 379818 - DNA, 269 bp, Homo sapiens
tccggttgaattttcaaagagaaatgggaagaaccttctctgtggcatgtacagagtaaattctgtctctaaatgctttttccaattaagaataattatgagaacggactgtaggacatatataaagaataaaacaaaaattgaaattgaaatatattatcttggaagaggtgttatctatgtcaaaaaaacccacaagattattgaagaatgaacatgtagttcccaaccaccttagttgctggccactctagagccatgtgggtttt

SEQ ID NO: 379819 - DNA, 370 bp, Homo sapiens
gcaaatgtattccttctcttatccctgtataatcagcagcagtcccgataattattataacacatttctagataatgttttagggtcttcagaagaaaatgagcataaaagtgaaatttcaaaaaatattgctgctatccaattatgtaactatggacaagccacacaattcttaaatgaacaaaattattaattttaaataaatgatgggtcacttttcttccactaggaatgtagagatcaggtaataagaaatttgaactttgtgactcattttcaaagatgagtataattgagaggaatgttcagaagtaaatgatgtaaatataaaaataaaataagacagtttatcagtagtctaaaggaaaat

SEQ ID NO: 379820 - DNA, 3175 bp, Homo sapiens
  misc_feature (743)..(743): n is a, c, g, or t
  misc_feature (1925)..(1925): n is a, c, g, or t
  misc_feature (2787)..(2787): n is a, c, g, or t
  misc_feature (2872)..(2872): n is a, c, g, or t
tttagaatcaaccctgctgctccgattctaattttcagttcagattttgcaggcacgagtgtgggtccctgagtacctgccctttgaattcttttggtgaggactgagcattcccccaggagcttctcatcgaaccccaaaaacacggcccccaattcaccacctcatcccttcccaggacctgctgaagctcacacccgtggaccacccagactgcctgccgctacaggatgccctccgcatctcccaggacttctttccggcatcagtgtggacattgaccccactggactgcagtcacagtggactcccaaggggcaggtgagctcatggcacagcaaggcctcacgctcaggttgaggagcccagagtggaccagatccccagtcccttctctgatggcacaggcatctctctgtgccccttgtctctgcaaccctgattccccattcccagccaaggagaggtcttcgatccctggtcatgctgatttgattccctgtggcattgtgggccctaggctgagagctttaagcccagtctctcaataatcctaagaatccagtgagccagaagagggcacaggaccagagagtctctccaggtacgccacacagtctttgagctgtgtcagagctggattgtttacctggggctggctgtttggaggccccaggcattgtcccccacaccagggaagttggcctgtgggtaactcgttcttgaatgcagacacctgcctntgccatcagggtgacccaggagggtgagggagcaggacatctcagccactttagattgacttgcatgagcaagagccaggaagggagccccacagagggaaaggctggtattagaggtggccaaggccatccaggttgctggaacattccacatgggctcctggatgtcaaacagcagtttccctgggggcccttcttggtggaagggtgggggttagtccagtgaggagaaacaacactcagcatgagaggcacaattaacccctgtgggtcggcagcctggcccagatcaaaggcttcctgaccgatagaggttgttatgtggccctgaggagtgaagactgcctgggttcatgctgctttgttacatttgtgagtgaggggcaggtctggagagtgtctgatggcgcataaggagctgtttctgtgcagttgttggttctggtttgcaaaaccatgggatatcactagtttggtttactctggggatatctgaaaaatctctggaagacttagagtagcatcagttgtaggtcatcttaactgtacggtttcaatgcacgcacctacatctcgcagtgtacacaggtcacacggtgtgtcatagagacaggaaagactgggacagatggttgcagccccgtggaagcccccctgactctgagggtggctgaggggaaactctggaaatcctcatggagtagaaaccatccagagcccaggtgagaggtggctgcaggtccccccaggacacttctgcagccccaaccgaaggcagcccggggtctcccatcccctgggtatatttgttaaaaatgtgtccatcatatatgaatttgggtttggtatttggttccctcgttgtgtcttgttctgtatttttgtgttaatgtcaataccgtattgtttggaccactatagctcttctatgtcatttgtaatcagggagcataatacatccatgtactttgtatttcccagtgatgagattgctagatgacatagtaattgtatttttagtttgaggaggaactgccaactattgctcatagtgtgtacacccatttacattcccaccagtagtgtctaagagtttccctctctgtaaatttacacttgtgattgcgttttaaaaattctgtttttgcttttggcaacattcattttatgtggatggggacnctgtcttagtgtgatttgatttaaatttttgtgatgattagtgatgtgggcaagctttttttttttacctgttcatttcctgccttcttttcagaaatgtctatcagttctttgcccaagttttgttggattagttggttttgtgtattttcctaccttatgttagtttctggtatatgtcagatgaacaccttcagctccatgattccttatacttaccgcctcacagcatcctgtgctcattctgtctcttccgctcaatgaccactgcctgtgtcccattcttctccctccccagggcagggcccagacctcctgcctcccatggaagcctggcccaatgcggggccagccacatggcacagtgtccagggcctttctgagtggtggacaggccagttggcatggaaaatggtgtctggggtttctgagttgactgttgaatgcagactcaacccactcacaaccagtcaccaccactgccacccaagcaagccacctgggagcctggaaattgctctgcccacctcttgccatgggcacagacacataccatagggaggactgccaacagacccagcccacctgcccctggtccccaaggatgacattcaggggcctggggatcaccccagcccaccaaccacaacctgtgtccatgcaggctcccacagggcctaaggacaggctgacccctcccagagaacccccaccccacaagtacccaagtacttcacccagggacctgggtatagacctgccctgccttccacttctggcatgtgcttgcaccagcagggggcctaacaacaggccagaccacctgatgccagcatcaggtcccatgccatcgtgggacctngggatcaccctgctctacccatgagcaccatcaggggccccggggcaggttcatcccacctggcatatgtatgcatgaactaganatgtgtttgcctgctgggcatggtggctcacgcctgtgatcacagcactttgggaggccaaggcgggtggatcacctgaggtcaggagtttgagaccagcctggccaacatggtgaaaccctgtctctactaaaaatacaaaaattagccaggcgtgctggcatgtgcctctagtcccagctactctggaggctgatgcaggagaatcgcttgaactcaggaggcggaggttgcagtgggccaagattgcgccactgctcttcagcctgggggataatccgattgagactccatctcaacagc

SEQ ID NO: 379821 - DNA, 931 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcttccgcacgacatttttaaactgggggcagctagcaccatgagtccgaactacgaggca

SEQ ID NO: 379822 - DNA, 791 bp, Homo sapiens
  misc_feature (764)..(764): n is a, c, g, or t
  misc_feature (771)..(771): n is a, c, g, or t
agcaatttgggaggtggaggaggagcaggaggaggaaaaggaaacaaccaggccagtcatggtgtctcgtgcctacgaggaggaggaagcggaggaggggaaaaaaaggaggagcgaaaagaaacggagcagaaggagttggaggaggaggaggtggaggaggaggagggaaaagaaatggagcagcaggaggagggaaaagaaatggaagaggaggagcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgagccgagatcgtgccactgcactccagcctggagacagagtgagactccatctcatctcaaaaaaaacaaaagaaaacaaaacaaaaacaaaaaaacagccaggagccgtggctcacgcctgtaatcctagcaatttgggaggcgataagaattattgaaatgcagtaagaattaccgaaatgttgaacaaagacaccaagtgagcacgtgctgttggaaaaatagcaccaatactacactagctcaacacaaggttgccacaatcctgtaatatattaaaatggccagcagggcggagggtgctaacttattaccttgagcagagcgtactagnagactcncactgcactgaaccttttaa

SEQ ID NO: 379823 - DNA, 2052 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379824 - DNA, 1580 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcagagatggggtctctctatattgcccaggccggtggtgaactcctgggttcaagccattcacccacctcgccctctggaagtgctgggattataggcatgagccactgcgcctggccttggatgagttcttattcaccttcctgtcggcctccacatgaagctccccaaaccttgtcctctttggtcttgtaaaaaaatatatataattaaaaaattaaagacagggtcttacta

SEQ ID NO: 379825 - DNA, 4366 bp, Homo sapiens
  misc_feature (1934)..(1934): n is a, c, g, or t
  misc_feature (3116)..(3116): n is a, c, g, or t
  misc_feature (3978)..(3978): n is a, c, g, or t
  misc_feature (4063)..(4063): n is a, c, g, or t
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggacctgctgaagctcacacccgtggaccacccagactgcctgccgctacaggatgccctccgcatctcccaggacttctttccggcatcagtgtggacattgaccccactggactgcagtcacagtggactcccaaggggcaggtgagctcatggcacagcaaggcctcacgctcaggttgaggagcccagagtggaccagatccccagtcccttctctgatggcacaggcatctctctgtgccccttgtctctgcaaccctgattccccattcccagccaaggagaggtcttcgatccctggtcatgctgatttgattccctgtggcattgtgggccctaggctgagagctttaagcccagtctctcaataatcctaagaatccagtgagccagaagagggcacaggaccagagagtctctccaggtacgccacacagtctttgagctgtgtcagagctggattgtttacctggggctggctgtttggaggccccaggcattgtcccccacaccagggaagttggcctgtgggtaactcgttcttgaatgcagacacctgcctntgccatcagggtgacccaggagggtgagggagcaggacatctcagccactttagattgacttgcatgagcaagagccaggaagggagccccacagagggaaaggctggtattagaggtggccaaggccatccaggttgctggaacattccacatgggctcctggatgtcaaacagcagtttccctgggggcccttcttggtggaagggtgggggttagtccagtgaggagaaacaacactcagcatgagaggcacaattaacccctgtgggtcggcagcctggcccagatcaaaggcttcctgaccgatagaggttgttatgtggccctgaggagtgaagactgcctgggttcatgctgctttgttacatttgtgagtgaggggcaggtctggagagtgtctgatggcgcataaggagctgtttctgtgcagttgttggttctggtttgcaaaaccatgggatatcactagtttggtttactctggggatatctgaaaaatctctggaagacttagagtagcatcagttgtaggtcatcttaactgtacggtttcaatgcacgcacctacatctcgcagtgtacacaggtcacacggtgtgtcatagagacaggaaagactgggacagatggttgcagccccgtggaagcccccctgactctgagggtggctgaggggaaactctggaaatcctcatggagtagaaaccatccagagcccaggtgagaggtggctgcaggtccccccaggacacttctgcagccccaaccgaaggcagcccggggtctcccatcccctgggtatatttgttaaaaatgtgtccatcatatatgaatttgggtttggtatttggttccctcgttgtgtcttgttctgtatttttgtgttaatgtcaataccgtattgtttggaccactatagctcttctatgtcatttgtaatcagggagcataatacatccatgtactttgtatttcccagtgatgagattgctagatgacatagtaattgtatttttagtttgaggaggaactgccaactattgctcatagtgtgtacacccatttacattcccaccagtagtgtctaagagtttccctctctgtaaatttacacttgtgattgcgttttaaaaattctgtttttgcttttggcaacattcattttatgtggatggggacnctgtcttagtgtgatttgatttaaatttttgtgatgattagtgatgtgggcaagctttttttttttacctgttcatttcctgccttcttttcagaaatgtctatcagttctttgcccaagttttgttggattagttggttttgtgtattttcctaccttatgttagtttctggtatatgtcagatgaacaccttcagctccatgattccttatacttaccgcctcacagcatcctgtgctcattctgtctcttccgctcaatgaccactgcctgtgtcccattcttctccctccccagggcagggcccagacctcctgcctcccatggaagcctggcccaatgcggggccagccacatggcacagtgtccagggcctttctgagtggtggacaggccagttggcatggaaaatggtgtctggggtttctgagttgactgttgaatgcagactcaacccactcacaaccagtcaccaccactgccacccaagcaagccacctgggagcctggaaattgctctgcccacctcttgccatgggcacagacacataccatagggaggactgccaacagacccagcccacctgcccctggtccccaaggatgacattcaggggcctggggatcaccccagcccaccaaccacaacctgtgtccatgcaggctcccacagggcctaaggacaggctgacccctcccagagaacccccaccccacaagtacccaagtacttcacccagggacctgggtatagacctgccctgccttccacttctggcatgtgcttgcaccagcagggggcctaacaacaggccagaccacctgatgccagcatcaggtcccatgccatcgtgggacctngggatcaccctgctctacccatgagcaccatcaggggccccggggcaggttcatcccacctggcatatgtatgcatgaactaganatgtgtttgcctgctgggcatggtggctcacgcctgtgatcacagcactttgggaggccaaggcgggtggatcacctgaggtcaggagtttgagaccagcctggccaacatggtgaaaccctgtctctactaaaaatacaaaaattagccaggcgtgctggcatgtgcctctagtcccagctactctggaggctgatgcaggagaatcgcttgaactcaggaggcggaggttgcagtgggccaagattgcgccactgctcttcagcctgggggataatccgattgagactccatctcaacagc

SEQ ID NO: 379826 - DNA, 1956 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtaagcggcagtttggctcatgggataatgtacccgtcctcattttttcaggttgccttgcccattctggacacttagattgtaagaatattggaaacaaagcgaggagctggtttaatccatgcaggttgcgttgaggatttcctaggaaaagtgagttgtgcttagtaagtaggaaagcagtcaggcccctgcttcccaaatacagtcaaaaagcaaacaggagagtctgctatagtgagatgtaaatggctagcttgcctttttcttgtctatttcatagccaaggaggaaggaaaaactggacc

SEQ ID NO: 379827 - DNA, 2074 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggatccacctctgatgttcagtgaagactaccagaaaagtctgctagagcagtaccatctgggtctggatcaaaaactcagaaaatacgtggttggagagctcatctggaattttgccgatttcatgactaaccagtagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379828 - DNA, 1437 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaagaagagtgagctcctcaccctgaattctcagggttcacaggcatgcaggggctgtggggagtacaatca

SEQ ID NO: 379829 - DNA, 1210 bp, Homo sapiens
  misc_feature (1103)..(1103): n is a, c, g, or t
  misc_feature (1169)..(1169): n is a, c, g, or t
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggcggctgcggcattttgtcngctggttgtggtatgaacgggaggtgaccctgctggagcgatggatccaggacctgtgcacagagnggtgctgaggattggcagtgcccacttctatacctcgtgtt

SEQ ID NO: 379830 - DNA, 4147 bp, Homo sapiens
  misc_feature (1715)..(1715): n is a, c, g, or t
  misc_feature (2897)..(2897): n is a, c, g, or t
  misc_feature (3759)..(3759): n is a, c, g, or t
  misc_feature (3844)..(3844): n is a, c, g, or t
ggcttctgaccgctcaccctcccccgtcaactccttacgtagtcaccattatgaaaaagtgtgccccttcagcaccttgggaagacctggatataaccagggtcccaggtttgaggagacagtgctgggtcaaacagcctttattttagcagttgtgagaccctagagaactcctttggtgttttggggtctccccagcatgcacaatgggggttatgctagcatctctttcctagggaactcatgaggttatgtttgagataaatatttaaaaactcatggtgtggtgttccctgtggatattgcacacacttagaaatggaacaaatacaagaaggggtgagaggtaacgtctaatgcaactccagtgggcctggggtccacagtgtgatctcgggaaaagacacttttgctctgggcctcatctttcatgctgcaccagtagaggttgagattaaatgaaattcagacatcctcctcctatgacattgcaccttccagtgccttcccattttgtttagacccagaccctgtgcctcatctcagcctagggtgggcagcgtccacagagacagcactgaggggttagtgactcccttctgaatgatggaatatgacacagatgatggaatagcacttctgggctagttcaggctgttacagcaaagaaagagctgtaacggcctggggagctcatcaaaaacagaactgtatttctccctgttctggaggctggaagttggatatcagagtagcagcgtggtcgggcttagtggtgacactgccgccccattcattgagcttttataggtgctgtcctttccttggaggacgcctcaactttaggagcatgggtagacctccattcaaagcccagctcccccttgtagcttggtgatcgtgaggaagtcatagaacatccctgtgcctgttttctcctctgagaaatggcgttagtgagaattgtttccctttttaatcacagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggacctgctgaagctcacacccgtggaccacccagactgcctgccgctacaggatgccctccgcatctcccaggacttctttccggcatcagtgtggacattgaccccactggactgcagtcacagtggactcccaaggggcaggtgagctcatggcacagcaaggcctcacgctcaggttgaggagcccagagtggaccagatccccagtcccttctctgatggcacaggcatctctctgtgccccttgtctctgcaaccctgattccccattcccagccaaggagaggtcttcgatccctggtcatgctgatttgattccctgtggcattgtgggccctaggctgagagctttaagcccagtctctcaataatcctaagaatccagtgagccagaagagggcacaggaccagagagtctctccaggtacgccacacagtctttgagctgtgtcagagctggattgtttacctggggctggctgtttggaggccccaggcattgtcccccacaccagggaagttggcctgtgggtaactcgttcttgaatgcagacacctgcctntgccatcagggtgacccaggagggtgagggagcaggacatctcagccactttagattgacttgcatgagcaagagccaggaagggagccccacagagggaaaggctggtattagaggtggccaaggccatccaggttgctggaacattccacatgggctcctggatgtcaaacagcagtttccctgggggcccttcttggtggaagggtgggggttagtccagtgaggagaaacaacactcagcatgagaggcacaattaacccctgtgggtcggcagcctggcccagatcaaaggcttcctgaccgatagaggttgttatgtggccctgaggagtgaagactgcctgggttcatgctgctttgttacatttgtgagtgaggggcaggtctggagagtgtctgatggcgcataaggagctgtttctgtgcagttgttggttctggtttgcaaaaccatgggatatcactagtttggtttactctggggatatctgaaaaatctctggaagacttagagtagcatcagttgtaggtcatcttaactgtacggtttcaatgcacgcacctacatctcgcagtgtacacaggtcacacggtgtgtcatagagacaggaaagactgggacagatggttgcagccccgtggaagcccccctgactctgagggtggctgaggggaaactctggaaatcctcatggagtagaaaccatccagagcccaggtgagaggtggctgcaggtccccccaggacacttctgcagccccaaccgaaggcagcccggggtctcccatcccctgggtatatttgttaaaaatgtgtccatcatatatgaatttgggtttggtatttggttccctcgttgtgtcttgttctgtatttttgtgttaatgtcaataccgtattgtttggaccactatagctcttctatgtcatttgtaatcagggagcataatacatccatgtactttgtatttcccagtgatgagattgctagatgacatagtaattgtatttttagtttgaggaggaactgccaactattgctcatagtgtgtacacccatttacattcccaccagtagtgtctaagagtttccctctctgtaaatttacacttgtgattgcgttttaaaaattctgtttttgcttttggcaacattcattttatgtggatggggacnctgtcttagtgtgatttgatttaaatttttgtgatgattagtgatgtgggcaagctttttttttttacctgttcatttcctgccttcttttcagaaatgtctatcagttctttgcccaagttttgttggattagttggttttgtgtattttcctaccttatgttagtttctggtatatgtcagatgaacaccttcagctccatgattccttatacttaccgcctcacagcatcctgtgctcattctgtctcttccgctcaatgaccactgcctgtgtcccattcttctccctccccagggcagggcccagacctcctgcctcccatggaagcctggcccaatgcggggccagccacatggcacagtgtccagggcctttctgagtggtggacaggccagttggcatggaaaatggtgtctggggtttctgagttgactgttgaatgcagactcaacccactcacaaccagtcaccaccactgccacccaagcaagccacctgggagcctggaaattgctctgcccacctcttgccatgggcacagacacataccatagggaggactgccaacagacccagcccacctgcccctggtccccaaggatgacattcaggggcctggggatcaccccagcccaccaaccacaacctgtgtccatgcaggctcccacagggcctaaggacaggctgacccctcccagagaacccccaccccacaagtacccaagtacttcacccagggacctgggtatagacctgccctgccttccacttctggcatgtgcttgcaccagcagggggcctaacaacaggccagaccacctgatgccagcatcaggtcccatgccatcgtgggacctngggatcaccctgctctacccatgagcaccatcaggggccccggggcaggttcatcccacctggcatatgtatgcatgaactaganatgtgtttgcctgctgggcatggtggctcacgcctgtgatcacagcactttgggaggccaaggcgggtggatcacctgaggtcaggagtttgagaccagcctggccaacatggtgaaaccctgtctctactaaaaatacaaaaattagccaggcgtgctggcatgtgcctctagtcccagctactctggaggctgatgcaggagaatcgcttgaactcaggaggcggaggttgcagtgggccaagattgcgccactgctcttcagcctgggggataatccgattgagactccatctcaacagc

SEQ ID NO: 379831 - DNA, 1620 bp, Homo sapiens
catctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379832 - DNA, 1322 bp, Homo sapiens
catctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtggttgaggagtgggcccagggcaccttcaaactcaaccccaatgatgaggacatccacacagccaacaagtgccacctgaaggtggtcacggacctcaggttgtggatgtggcagacctgctttcacgctctcgggcctcctctgggagctcatcaggactatgggggattgggcagaggtgttcctgctccagcgtggctcctggactggcgccagatgctggccctgggggtttcaatccaagcataattcagtgaagcatgtgttt

SEQ ID NO: 379833 - DNA, 1359 bp, Homo sapiens
ggcttctgaccgctcaccctcccccgtcaactccttacgtagtcaccattatgaaaaagtgtgccccttcagcaccttgggaagacctggatataaccagggtcccaggtttgaggagacagtgctgggtcaaacagcctttattttagcagttgtgagaccctagagaactcctttggtgttttggggtctccccagcatgcacaatgggggttatgctagcatctctttcctagggaactcatgaggttatgtttgagataaatatttaaaaactcatggtgtggtgttccctgtggatattgcacacacttagaaatggaacaaatacaagaaggggtgagagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379834 - DNA, 1216 bp, Homo sapiens
ggcttctgaccgctcaccctcccccgtcaactccttacgtagtcaccattatgaaaaagtgtgccccttcagcaccttgggaagacctggatataaccagggtcccaggtttgaggagacagtgctgggtcaaacagcctttattttagcagttgtgagaccctagagaactcctttggtgttttggggtctccccagcatgcacaatgggggttatgctagcatctctttcctagggaactcatgaggttatgtttgagataaatatttaaaaactcatggtgtggtgttccctgtggatattgcacacacttagaaatggaacaaatacaagaaggggtgagagaaaataaagcatgcgaagaagttaacttggtgccattgggcagagggtgagagcccagcaaaccggagagatcagctgcccacatcagtggcgaggagtgcggagagtgggtgaggctggggcaggaagcaggccagcctgccagagcccaggaacaggtgaaaggatccacctctgatgttcagtgaagactaccagaaaagtctgctagagcagtaccatctgggtctggatcaaaaactcagaaaatacgtggttggagagctcatctggaattttgccgatttcatgactaaccagtagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379835 - DNA, 615 bp, Homo sapiens
tgcgaggcgacttggggaaaacgcaggcagggtattgaacccgtgaaaggttacgcaaatgtatgtttgaaagtggaaatgaaacaaggattttctctgccacacagacagcaggttggcgaaaagttaaaagcgtgttagtattcaggggaggctgcgttcagagaagcagctaccttcagaggctgctggtgaccgtgtgaccagctggagcccttttggaaagtcaactagctagagctgttgaaagttgatatctgcatatcctttcacccagatatccctttcctgggtgtctgtctgctgcaggggatttgtttattttatgggttgaattgtgtccccttccccaaatgtaactgtttctattctcaaccccagagactcagaatgtgactgtgtctggacacagagtactccaagaggtaattcaggtgaagtgagttcattagggtggcccctaatttaacatgcctggggttcttacaaggagagggggtcagcgcacagagaagttcaagagaagaccctgtgctgactgagatagaagtccgccatctccaaggcaaggagagaggcccagagaaaccaccccaggctgacagtttgacgttg

SEQ ID NO: 379836 - DNA, 4526 bp, Homo sapiens
  misc_feature (1035)..(1035): n is a, c, g, or t
  misc_feature (1082)..(1082): n is a, c, g, or t
  misc_feature (1121)..(1121): n is a, c, g, or t
  misc_feature (1158)..(1158): n is a, c, g, or t
  misc_feature (1169)..(1169): n is a, c, g, or t
  misc_feature (1175)..(1175): n is a, c, g, or t
  misc_feature (1200)..(1200): n is a, c, g, or t
  misc_feature (1211)..(1211): n is a, c, g, or t
  misc_feature (1216)..(1216): n is a, c, g, or t
  misc_feature (1252)..(1252): n is a, c, g, or t
  misc_feature (1300)..(1300): n is a, c, g, or t
  misc_feature (1326)..(1326): n is a, c, g, or t
  misc_feature (1328)..(1328): n is a, c, g, or t
  misc_feature (1440)..(1440): n is a, c, g, or t
  misc_feature (1745)..(1746): n is a, c, g, or t
  misc_feature (1765)..(1765): n is a, c, g, or t
  misc_feature (1877)..(1877): n is a, c, g, or t
  misc_feature (2012)..(2012): n is a, c, g, or t
  misc_feature (2223)..(2223): n is a, c, g, or t
  misc_feature (2236)..(2236): n is a, c, g, or t
  misc_feature (2270)..(2270): n is a, c, g, or t
  misc_feature (2380)..(2380): n is a, c, g, or t
  misc_feature (2397)..(2398): n is a, c, g, or t
  misc_feature (2414)..(2414): n is a, c, g, or t
  misc_feature (2434)..(2434): n is a, c, g, or t
  misc_feature (2457)..(2457): n is a, c, g, or t
  misc_feature (2569)..(2569): n is a, c, g, or t
  misc_feature (2648)..(2648): n is a, c, g, or t
  misc_feature (2876)..(2876): n is a, c, g, or t
  misc_feature (2907)..(2907): n is a, c, g, or t
  misc_feature (2930)..(2930): n is a, c, g, or t
  misc_feature (3034)..(3034): n is a, c, g, or t
  misc_feature (3236)..(3236): n is a, c, g, or t
  misc_feature (3238)..(3238): n is a, c, g, or t
agcaatttgggaggtggaggaggagcaggaggaggaaaaggaaacaaccaggccagtcatggtgtctcgtgcctacgaggaggaggaagcggaggaggggaaaaaaaggaggagcgaaaagaaacggagcagaaggagttggaggaggaggaggtggaggaggaggagggaaaagaaatggagcagcaggaggagggaaaagaaatggaagaggaggagcaggaggaaaatgaaatggaggaggaggaggaggaaaaagaaatggaggaggaaaaagaaacaggaggaggaaaaagaaacggaggaggaagaggaggaggaggacaaagaaacagccaggccggacgtggtggctcacccctgtagtcccagctgctcgggaggctgaggcagaagaatcgcttcaacccgggaggcagagtttgcgtgagccgagatcgtgccactgcactccagcctggagacagagtgagactccatctcatctcaaaaaaaacaaaagaaaacaaaacaaaaacaaaaaaacagccaggagccgtggctcacgcctgtaatcctagcaatttgggaggcgataagaattattgaaatgcagtaagaattaccgaaatgttgaacaaagacaccaagtgagcacgtgctgttggaaaaatagcaccaatactacactagctcaacacaaggttgccacaatcctgtaatatattaaaaattgggccaggcaaggggccgggaggggtggctcacacctgtaatctcagcactttgggaggccaaggcaggcggatcacctgaggtcaggagctccagaccagcctggccaacatggtaaaaccccatctctactaaaaatacaaaaattggctgggggtgatggtgggtgcctgtaatcctagctactatgtaggctgaggcaggagaaccacttgaacccgggtggtggaggttacagtgagccaagatcgtgccatggcactccagcctgggtgacaagagcaaaacttcatctcaaaaaaaaagaaaagaaaagaaaanaaatgggccaggcgggctgggtgcagtggctcatgcctgtaattccngcacctttgggaggctgagatgggtggatcacgaggtcngaagtttgagaccagcctggccaacatggtgaaaccncatctctactnaaaatngaaaaattatcctggcgtggtggcnagcgcttgtantcccngctactcgggaggttgaggcaggagaattgcttgancctgggaggtggaggttgtagtgagtgaagatcttgccactgcactcnagcctgggcaacagccagactctgtntnaaaacaaaccaacacaaacaaacaaaaacaaaccccaaaaccaaaattgatatttcccgtgtacattcgaccttgactgttgctcattcaacccagcccaactcagtgcccnatcccctggccctgaagagaccattctggcccagaagtgtcctggctcggagcagcaccttctgctaccacactgggcctcccttctcctcagtgcccaaggggaggcacctcactctgatctcccagtggcatcctattatgcctgccagtaaggataggcgcttggtcctagagcagagtggtctgccgttggaccagcccagcactccaggtgacctcagcctgccccaggccttcctgtaggttggcactaattggtttggctgcagccttgcatatttagcagtttttattactaataanncaggcagggtggcccaggnccccgctgggggaggtactgccaggctcccagctgaggggcaggctggctccaattctgactggctggccccagtgatcagaaagatccaggccccacctagtgctttgctngagatctaggcttggtggggcagcttgtggggtaaggggcaggaccagctcaaaagacggggtgggggcggaggctccctctgcagggcagagtcctttggcagctggggctgttgggcatggaggggtcagttnacagctcagggccagagcacggtagaggtctctgggtgcacacaagaaccaggagtggagctgaaacatgtcctgtcccctgcctgccctcccttagtaactgctggcatttcccaattccttcctgagcaccaggcaccatgttatgcatgcaatttgcaaatgttacctgattgaatgctcaaaacaaggctatcacataggtactgtnttatttttcagangatgtcttgctctgtcacccaggctggagtgcantggtgccatctctgttcactgcaacctccacctccagggttcaggtgaatctcctgcttcagactttcaagtagctgggactatagctgcccgccactgcgcctggctantttttgtattttcagtnnagacagggtttccccntgttggccgggctggtctcnaactcctgacctcaagggatccncccatctgggcctcccaaccctgagtttttataataggccccaggccaggtggttaacagaggtctggggcattgcagggggacagaggaggacatatgtccctattggccnttgtagagtcccttccacaaaaaggatgtcagtcaagtgacgtgcccacctccaccccaccctccccccagtcctgggnactaggactacttcccaggtgccctgtacccttccccgatctgtcccatgccctggcctctgcccgctttcaaaacatagatgtggccagcgccttggcttatgcctataatcccagcactttcggaagcagaaggattgcttgagcccaggagttcaagaccagcctgggcaacatagatcctgtctcaacatattttctgcaaaatttttgtttttcctagacagngttccagcctgggcgaccaagtgagactccntgtctcaaaaataagaacaaaangtagatgcctacgtaccatctctctacccttggctcctggggagtaagggtcacccagtgacctcctagaaggccagtgacaatggggggtgtcagagtgctcntcagagccaagggagcagtaggaattgggatcttagtctcttagtctgactccaagctgtgagggagagagttgcagggcacttaagcttggtggagaccgtcagtgcctccttgcctgtccctgcagcaaaagttcaggacaccagagccaagctcagaggccgtggtggaacaggggtgaagagcatgggttctgacttnanactgctgggctgcagccctggctctccctccccgggtaagggcaggctgcatgcctccctgtgcctcagtttccccctcttcatagtgggattgtattggtgcctaccccagagagttgtgtcatcaattaggatggcacctggcaccttggtcagtggcaggaaaggttccagaagctctgctctggtcccggggtgcctcgggccctgccaccatctccttggggtggtgccatgtggtgggaaagaccccaacttcaaggccagacgcagtggctcatgcccataatcccagcactttcagaggccgagatgggaggatcacctgaggtcaggagttcaagaccagcctggccagcatggtcaaaccctgcctgtactaatgatccaaaaattagccaggtgtggtggtgcgtgtctgtagtgccagctactcgggaggctgaggcaggagaatctcacgaacccgggaggcggaggttgcagtgagccgaggttgcactactgcagtccagcctggctctgtcttggtgttcagccatgttcccatgctcactcccaaggtgactctgggaaggtctcagcctttttgtcttcccagttaggatggtcccatgcccctgttaccatcagacttggtaagtttcccgaggagactctgcaagaggcactgttctggatggtggaggagagactagttgttctgctctcctggccacagtgggtgcagtggaccccatcatggagaagttcaacacatccagcctacgaccagcacctgtgggaggtggatattcaaggcagcagagcctacagccggggcatggagaaggcagggctcctcgccaaggccgagatggatggttttacgttgaactaattatatactcaagtgctgtttaactgtgtgccttgacctcttctctcctttaatgatccctgtggcccacatggcttatgggtaaaggtgtgctgggctcgagatgccccctcccagggtgcacttccaggactcagctcctggacagggacagtcagtcatcaggaataaggtgggatcagggcaggggctctcggctgctgatgcctgctcacctgacccctggtattgctgctacgtgctataggtggttgaggagtgggcccagggcaccttcaaactcaaccccaatgatgaggacatccacacagccaacaagtgccacctgaaggtacgaaccctgcagccccactgccttcctggcctcccctctccaccttgcgcggggccactttgagcattagcacc

SEQ ID NO: 379837 - DNA, 1791 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtaagcggcagtttggctcatgggataatgtacccgtcctcattttttcaggttgccttgcccattctggacacttagattgtaagaatattggaaacaaagcgaggagctggtttaatccatgcaggttgcgttgaggatttcctaggaaaagtgagttgtgcttagtaagtaggaaagcagtcaggcccctgcttcccaaatacagtcaaaaagcaaacaggagagtctgctatagtgagatgtaaatggctagcttgcctttttcttgtctatttcatagccaaggaggaaggaaaaactggacc

SEQ ID NO: 379838 - DNA, 1754 bp, Homo sapiens
tgagtgaaccccaacctttggagaaccccagtgagcctctccagatgtctgagtgggcctgtggctcctttttcagcaccaagggacccctcttctgtctgtgtcaaggagaaagaccagccagaaggaatctcagacatcctttaccagtgccatcgcagacttggtttctatgtgtttttccaaacagtgagtgatacaggccattgaggcagaatgctgagagctgcttcaagtgagggggaagagaaaagtaacaaacatgaatcacagcacccccagcagattttccagagttttaggctctagggacccctttgtttgctgtgtcttagatcattgagtccctacaagaaccctgtgaggttcgtcttctcactactccctgttccagaggagccaaccgaggctccgagaggtgcatcttcaagacagagccagtaggggacagaggcacctctgtgtcttggagggggatggacactcaccttctaaccagtagttccaaaaagtgtggcacagtgataaagtcccaggaggggcccaggcaggtggcataggaggagatgggtttagttagaaaggctggaaccagggactcccaacagcttctccccagtgccgggctggaaagttagcatcctgcagatctcattttcatactagggggacaaggagggacatgggagtcagtggtaacaccatggaccaccagaggatcgggatctggaactcacaccaagaagcaccaacccttcagggacttgtgcatatggagaacctgggtgcccatggtgaaaagcgttctaggctttcaaagtaacattgcatgtgaggatggagaatgataaaacgattcctgccttcaaggcatcgtcccggtgtttgtcagctgtggggcaacagcaccctctgtgtcagcaacctgcatgaagagcatcatccctgcaagtcctcaaggcctggggaggcctcatcccctcctcatttcagcaacagcacacaggacaatacgctctagaagaactctttgacttaaaggtatatgattgtttttgttcctttaacatgaacgtgagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtggttgaggagtgggcccagggcaccttcaaactcaaccccaatgatgaggacatccacacagccaacaagtgccacctgaaggtggtcacggacctcaggttgtggatgtggcagacctgctttcacgctctcgggcctcctctgggagctcatcaggactatgggggattgggcagaggtgttcctgctccagcgtggctcctggactggcgccagatgctggccctgggggtttcaatccaagcataattcagtgaagcatgtgttt

SEQ ID NO: 379839 - DNA, 371 bp, Homo sapiens
attgtgacttcgacctggagttaattttctttgcagtaaagcgagactggtgacttagaattgttgtcaagggttttctagctgaaaaaaaaaaatattgtcagctaaaacaagtacatatttgtattgaaaacgacatagatgttttctctttagtttgtgattatagggacatagtttgaaagtgaatttcttcaataagattaatttccaaaaaaaaagttattttgtttcatttttgctggttttgaatgcaactgtttgttaccagtgccaaaacagtggatgtgaatgaaatgtatagtcagacggaaatttcacgtcactgagtggaatttcacccttctttaaaagtctccgctttctgcctt

SEQ ID NO: 379840 - DNA, 1518 bp, Homo sapiens
  misc_feature (1511)..(1518): n is a, c, g, or t
tggttgcctagcaaccggtggtgccaaacactggagctcagagcggggggcgcggagagcgaagcgggaaaggaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacgcggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctcagnnnnnnnn

SEQ ID NO: 379841 - DNA, 1748 bp, Homo sapiens
  misc_feature (1741)..(1748): n is a, c, g, or t
ggcgggagggcgtggcggctaccagacggggagggggccgccccgggggccgccccccagctccccagtgccaacaggcacgcgtccctggagacagaacagggctcctgcccttagatcccccacggggactggcccgcagcctggggaagaaaggaaaggaagatcaacaaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagagacggggtttcaccattttggccaggctgttctcgaactcctgacctcaagtgttccatccaactcggcctcccgaagtgctgggattacagatgtgagccaccgtgcccggccgcgccctcttttctagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacgcggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctcagnnnnnnnn

SEQ ID NO: 379842 - DNA, 1522 bp, Homo sapiens
  misc_feature (1515)..(1522): n is a, c, g, or t
ggcgggagggcgtggcggctaccagacggggagggggccgccccgggggccgccccccagctccccagtgccaacaggcacgcgtccctggagacagaacagggctcctgcccttagatcccccacggggactggcccgcagcctggggaagaaaggaaaggaagatcaacaaggcatggttggctgggggcaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacgcggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctcagnnnnnnnn

SEQ ID NO: 379843 - DNA, 282 bp, Homo sapiens
gccttatgtattttgtgacatttgatcaggagctcatgcgtcttagtattttatgggtgggaattctttgaagcttggattgaggttaattttttaaagaaaggattatatttagtcacaccagttgactgggaacactactaacctaatcattttgaataatttattttaaattaatcattagctagaggtgttatggactttgtggcttcaaattctcaagggaaaaatttttgttcccctccatcaagcagcatgttttgccacagacaattttcctgg

SEQ ID NO: 379844 - DNA, 975 bp, Homo sapiens
  misc_feature (20)..(20): n is a, c, g, or t
  misc_feature (80)..(80): n is a, c, g, or t
  misc_feature (279)..(279): n is a, c, g, or t
  misc_feature (547)..(547): n is a, c, g, or t
  misc_feature (630)..(630): n is a, c, g, or t
  misc_feature (690)..(690): n is a, c, g, or t
  misc_feature (858)..(858): n is a, c, g, or t
  misc_feature (863)..(864): n is a, c, g, or t
  misc_feature (880)..(881): n is a, c, g, or t
  misc_feature (884)..(884): n is a, c, g, or t
  misc_feature (908)..(908): n is a, c, g, or t
  misc_feature (928)..(928): n is a, c, g, or t
  misc_feature (957)..(957): n is a, c, g, or t
atgttctttatacataaganggttcatataggacagacctttggtaaatataatgaatatgagaaagcctgtaataactnagctattattgtccaagggataactcaggtaagacagccaacttgctgtagaaagtctgacttcagtaaacatcagcaaacacacacaggagagaaaccccatgaatgtgttgaatgtgagaaaccctccattagcaaatcagacctcatgatacagcacaagatgcctactgaggaaaaaccttatgcctgtaactgntgtgaaaaattgttcagctataagtccagcctcactatccatcagagaattcacacaggggaaaagccctatggatgcaatgaatgtggaaaaaccgttcgctgtaagtcattcctcactttacatcagagaactcacactggggataagccctacaaatgtattgaatgtggaaaaacttcactgtaaatcacttctcactttacatcacagaactcactcaggggaaaagccctatcagtgtagtgaatgtggaaaaacctttagncagaagtcatacctcacaatacatcatagaactcacacctggcaaaagccctatgcatgtgaccattgtgaaaaagcatttanccataagtcaaagcttactgtccatcagagaacacacacaggggaaaagccctatgaatntaatgagtgtagaaaaccctttatcaataagtcaaacctcaggatacatcagagaactcacattagaaaaaccctatgaatgcaatgaatgtgggaaaacgtttcaccaaaagtcgttcctcactgtccatcaaaggactcacaggcgaaaaaccctacgaatgcaangaacnngggaaaacctttcacnntangtcattcctcactgtccatcaganaactcatactggggaaaaancatatgcatgtaacaaatgtggaaaaacntatagccacaagtcataa

SEQ ID NO: 379845 - DNA, 353 bp, Homo sapiens
ggggggcggggatggtaaatctctttatcaaaaatatactgtaatatgagatgttttaatttatttttctcttacttcaaattgctaacaaatgatccccaacacctccaactgatttatgctcttttccagtgacagggtctacttctgagatattttactccagggtacatgtctataattaactaactttaaaaagtgaggaaagaatatatttagccttctcagctaaaaacatactattttcctctatttctaagaagtttcctttaaatacagtaaggtttctttaaacagttctcatttagataacattgtttttccccatactatcaacgaacagaatttagcga

SEQ ID NO: 379846 - DNA, 334 bp, Homo sapiens
gcgtcgacccaagccagatgcagaagtgggaattgtctggattgttttcagggtgttaatgaaccctaggaatagcaggcaggaggcttcagcagcctcacccactggcataattcctgctgagaccactgggggctggcccatcctacagtctggccatctctccccatgagccatcacccttgccctccactctggtttggctgggatgctgggaagtggctttttcctgaggctctttagagaagaggtcccctcagcatgggatgtgggccaagtctctgtgagctgcaattgcttcttcacagggtcccagggcctccgtcgacgagag

SEQ ID NO: 379847 - DNA, 1228 bp, Homo sapiens
agcctctctgtggaagggcagcctgcgcctgggtaccgaggctgctgcgcggcggacagcgggcgcgatgtatctccgcagggcggtctccaagactctggcgctgccgctgagggcgccccccaaccccgcgccgctcggaaaggacgcatctctgcgccggatgtcatctaacagattccctggatcatctggatcaaatatgatttattatctggttgtaggcgtcacagtcagtgctggtggatattatgcttacaagacagtcacatcagaccaagccaaacacacagaacataaaacaaatttgaaagaaaaaacaaaagcagagatacatccatttcaaggtgaaaaggagaatgttgcggaaactgagaaagcaagttcagaagccccagaagaacttatagtggaagctgaggtggtagatgctgaagaaagtcccagtgctacagttgtggtcataaaagaggcatctgcctgtccaggtcacgtggaggctgctccggagaccacagcagtcagtgctgaaaccgggccagaggtcacagatgcagcggcgagggaaaccacggaagtaaaccctgaaacaaccccagaggttacaaatgctgccctggatgaagctgtcaccatcgataatgataaagatacaacaaagaacgaaacctctgatgaatatgctgaactagaagaagaaaattctccagctgagtcagagtcctctgctggagatgatttacaggaggaagccagtgttggctctgaggctgcttcggctcaaggctaatctccagccggtagacatttcagcaacaaatgccatagggtgtctgataagtgcttttgtgtttttagtacacttagtttaaaaaaaaaaagacttattttctagaaaacgttaatgggtcttgaagatttttggcatccactgatagattttaggactgagagacttgagattgtacatttcttactactcttctactgtctgagatcagaatatgacattgcagtaaagagcttaaatagtttcatctttggtttttttttctagacacttttcttttatcccagtcatctctgaatttacattttatattaaagaaattgagctatccatacaacctgtatttactttaatttcactatgctttcagcttactttattgtatgatatgtaggtctaaaatatagtttgagtcaaataaaattagaaaagctttgg

SEQ ID NO: 379848 - DNA, 1838 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaagcacgaggtgggacgtgctggtgtgtgaccggcagtcctgccagctgttttggctagccgaggaaggtggagatgaagacgctggtgtcaaggttgagcgtagcatgccaccagcggtcggggaag

SEQ ID NO: 379849 - DNA, 253 bp, Homo sapiens
gcggccgctccaacatcagaacttgggggaagcggtcggggtggccaggaacataaactatgtataggggccgggctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379850 - DNA, 1749 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaagcacgaggtgggacgtgctggtgtgtgaccggcagtcctgccagctgttttggctagccgaggaaggtggagatgaagacgctggtgtcaaggttgagcgtagcatgccaccagcggtcggggaag

SEQ ID NO: 379851 - DNA, 1567 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtcctggcctgagatgggatcctctagacgcctgca

SEQ ID NO: 379852 - DNA, 2089 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcgtgagtgcgcccgcgcggggagggcggcggcggtggcaccggggagggccgggcccgggcccggccggccccaccgagggtctggctcctcttcggggcgtgtcctcggctcccaaagcccagccgtggttctcgagcccagcgccgggtgccggagaacgagggtgcgatgctggatggaggccggccgggtggggggagggcaggggccctcgacccttgaggaccccaggtcctaagcccggactctccaaagatttggaaaactttacaaaaccaagtggaatcaagcggataggctcagccagtactccactgtgcacagatccttggacccaggggctttgacaactgagaaacctagtttcttgattctagccagagcgcagaagctgggacgggccgtgggtcagagtgggcacgctgagcctacgccctcatgcggctggcccggccttggtccctagacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379853 - DNA, 1761 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagcactcaactcttcacaggacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379854 - DNA, 1645 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtgagggtgccccccacccacatgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379855 - DNA, 1710 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379856 - DNA, 1849 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379857 - DNA, 1831 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaagcacgaggtgggacgtgctggtgtgtgaccggcagtcctgccagctgttttggctagccgaggaaggtggagatgaagacgctggtgtcaaggttgagcgtagcatgccaccagcggtcggggaag

SEQ ID NO: 379858 - DNA, 1792 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379859 - DNA, 1931 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379860 - DNA, 1056 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccatcgagatgtggcgcgagatgtggcgcgagatgtgagcggggcgagctcgatt

SEQ ID NO: 379861 - DNA, 835 bp, Homo sapiens
gggatgtgctgcggtcgttctagaggatccctcagcacactggaggatgcagcaccagaggatggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379862 - DNA, 1622 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379863 - DNA, 1799 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaaaaaaaagcattacatagaaacaaaaaacaaaggggggcgcgaaaaagacccgaggggccaattttgcccgccccgtttgtgcacggggcccaaaggggcgaaaaaaaaggacgggcggtaccccggggggaacccccgggctgggagccccccgggggaaggcacccaaaaccgga

SEQ ID NO: 379864 - DNA, 1699 bp, Homo sapiens
  misc_feature (99)..(99): n is a, c, g, or t
  misc_feature (111)..(112): n is a, c, g, or t
  misc_feature (117)..(117): n is a, c, g, or t
  misc_feature (120)..(120): n is a, c, g, or t
  misc_feature (127)..(127): n is a, c, g, or t
  misc_feature (130)..(131): n is a, c, g, or t
  misc_feature (136)..(136): n is a, c, g, or t
  misc_feature (138)..(138): n is a, c, g, or t
  misc_feature (155)..(157): n is a, c, g, or t
  misc_feature (164)..(165): n is a, c, g, or t
  misc_feature (171)..(171): n is a, c, g, or t
  misc_feature (175)..(175): n is a, c, g, or t
  misc_feature (188)..(189): n is a, c, g, or t
  misc_feature (253)..(253): n is a, c, g, or t
  misc_feature (433)..(434): n is a, c, g, or t
cttgggaagtaattctgacttcctgtacaattgcctgataagtctcttctgggctgtatgttgctcaagtggaagtccaagtttttgttacctccgacnattaattggttnnacacnccngtgtgtnaannccagnanggcaatgctctcgggtnnncccattnnttgganatanccagcttcagatnncaccaacaccagcaggcaacaatcaggacagcacagtcagcctgagatgtccctgtaatcatgnttttgataaagtctctgtgtcctggggcatcaatgatagtcacatagtacttgctggtctcaaatttccacaaggagatatcaatggtgataccacgttcacgctcagctttcatttatccaagacccaggcatacttgaaggagccctttcccatctcagcagcctccttctcaaattnnttcaatggttcttttgtcgatgccaccgcatttatagatcagatggccagtagtggtggacttgcccgaatctacgtgtccaatgacgacaatgttgatatgagtcttttcctttcccattttggcttttaggggtagttttcacgacacctgtgttctggcggcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379865 - DNA, 1565 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379866 - DNA, 1928 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttccgtataccagtaagttttcaatgtttccccttgggcacaagcgcgccagaacccgctttcgccgcccaatgtttcccttggcctggttttagagacctccttgtgaccttggctttttcccccccttaccttccaagggcaattccgggcctttttttttggcaccttcggtggggcccccggttgggaaaattcccggagttacacacacctcgtttttttgagggatgagagcgggcctatcgggggaacactaacacgcggccagacgcgggtctggacacgggcgggcgcgttaggggcggcctttcgtggacgcccgttttggaaatggcggaggccgcccagagtttttggcccaccacgtggcgcgccctaagccctttaaaattcctgtctcgggttggatcttcagacttttagcagtgagaacgtttctcccgagagttcgaaaaggcccaacgaggaaaaggagcgtcatcgg

SEQ ID NO: 379867 - DNA, 1704 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379868 - DNA, 2058 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatcacccggaacccgctggtggccgtgtattacaccaaccgggccttgtgctacctgaagatgcagcagcacgagcaggccctggccgactgccggcgcgccctggagctggacgggcagtctgtgaaggcgcacttcttcctggggcagtgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgtgagggtgccccccacccacatgtgggtctgtgtgtgtgcacgtggcgtgggagcatccccgccttgtgttgggtctgtgccccatggaggagggaggtggggtgtctcccccaagcacagcactcaactcttcacaggacaagtacatggcggacatggacgagcttttttctcaggtggatgagaagaggaaggtgagtgtgtgtcgcttgctgccgatggctggcaggtgctcgtgcagtgccccttttcagcctctgaccgtgtgcccctgtgccacagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacgaagcacgaggtgggacgtgctggtgtgtgaccggcagtcctgccagctgttttggctagccgaggaaggtggagatgaagacgctggtgtcaaggttgagcgtagcatgccaccagcggtcggggaag

SEQ ID NO: 379869 - DNA, 1557 bp, Homo sapiens
tgcgcgttgggacaggggcggaaccccaggtggtcgggacaggctgttgcgggagcgcgccctcagcgaagcaagtgaggcatctcactgggaaagtcgaatgtgtgtggcggccgccgccgaggcgggttccgaagagacctcagcagggcaggccagggcctacgcgaacgcccacccttaagagcgcggggacagggaactggagcgttcctcccagcccccgacgtcgcgggcccagtgtccccgtccaggctggttgggcgcacgcgcggccccactcgcccccacgcgtgcgtccccgctggtcccgcccccggccggaagttccggcggcggagctgggccgggcccgagcggatcgcgggctcgggctgcggggctccggctgcgggcgctgggccgcgaggcgcggagcttgggagcggagcccaggccgtgccgcgcggcgccatgaagggcaaggaggagaaggagggcggcgcacggctgggcgctggcggcggaagccccgagaagagcccgagcgcgcaggagctcaaggagcagggcaatcgtctgttcgtgggccgaaagtacccggaggcggcggcctgctacggccgcgcgatctgccagctggagatggagagctatgatgaggccatcgccaatctgcagcgagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagagggagctggaagagtgccagcgaaaccacgagggtgatgaggacgacagccacgtccgggcccagcaggcctgcattgaggccaagcacgacaagtacatggcggacatggacgagcttttttctcaggtggatgagaagaggaagaagcgagacatccccgactacctgtgtggcaagatcagctttgagctgatgcgggagccgtgcatcacgcccagtggcatcacctacgaccgcaaggacatcgaggagcacctgcaggtgaggcctgcggctgggggagcagggccagtggcatggtcctgggccccatgactgccctctgcccttcttgtcactgcagcgtgtgggtcattttgaccccgtgacccggagccccctgacccaggaacagctcatccccaacttggctatgaaggaggttattgacgcattcatctctgagaatggctgggtggaggactactgaggttccctgccctacctggcgtcctggtccaggggagccctgggcagaagcccccggcccctatacatagtttatgttcctggccaccccgaccgcttcccccaagttctgctgttggactctggactgtttcccctctcagcatcgcttttgctgggccgtgatcgtccccctttgtgggctggaaaagcaggtgagggtgggctgggctgaggccattgccgccactatctgtgtaataaaatccgtgagcacga

SEQ ID NO: 379870 - DNA, 406 bp, Homo sapiens
tattgtagtatcactgttgattgtgttatccatacttgtgtagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtaagttaagatctgaaagaaactcagtttttctaggtgcttttttcatgttactaacttttaatggtgcagagcaggaattctggaacttgactctcagctgtggctcatattagctgtgaccttgggcaagtggcttgacctttctgtgccctagtttcctcctttgtaatatgaagttgttaacggtacctgccacaggtttgtggtgagagctaacctca

SEQ ID NO: 379871 - DNA, 318 bp, Homo sapiens
cggcgcctttttttttaccagaaacacgtgcactttattgaatgccattgtagaaaagcgtgtgaggataaagggctgatacaggactcggctccgggggcagggcgaggaatggaagttggagtacgtgggatacaggtcatgggcagagctcctgtatcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379872 - DNA, 1287 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379873 - DNA, 1275 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379874 - DNA, 1569 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaaaaaaaaaaaaaaaaaaaaaaaacaaaaaaaaaaaacaaaaaaaaaacaaaaaaaaaaaaaaaaaaacagaagcgaacaacagcaccaacaaacacaacaaaaaacagacaaaagacgcaaccaacaacaaaagcacaaacaaaaagcgagcagcgcggccccgctccagctacaaccgccagaccacgcccgaacaagcgcgcgcgagagccagagacaagacagaggaccgacacctcagacgcacacccacactacgtaacgc

SEQ ID NO: 379875 - DNA, 1842 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctcggaaa

SEQ ID NO: 379876 - DNA, 1877 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagttgctcaggagaattagaaggcttaggatcaatagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctcggaaa

SEQ ID NO: 379877 - DNA, 1697 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattc

SEQ ID NO: 379878 - DNA, 1356 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggcagtttttcagaaagaggacagaatttgagattgtgcttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379879 - DNA, 1244 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379880 - DNA, 1244 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttaccttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379881 - DNA, 2241 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcgggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379882 - DNA, 1221 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgtaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379883 - DNA, 1286 bp, Homo sapiens
  misc_feature (821)..(821): n is a, c, g, or t
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccattttgngagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379884 - DNA, 1206 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379885 - DNA, 1845 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcgggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379886 - DNA, 931 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379887 - DNA, 2255 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtaatgttaaacgttactctgatgagggtttgacagcgatgtagaggtaagctacaatattaaattaagtaactgaaatcatgtttgcaactaccagtgatccagagccatttgatagtgtgtatttcctggtgattctaatgtagatactaaaattcaaggtttgatattggaagaactgtggattgaatatgaagtagctgcatggcgtttacctggcgggggggggtattgctggtatggggatgatgatcccaacccaagaattagaacctaatcttgggccaattgaccctaattttaaggttataggtggaaagttgatggcttgccaaaaattaacccattgctaatgagtataagggcttttaacagtcttagatctaactggtaacaagaatagaatcagttttctaaatctatgtaataaggattatgaaacttctttttttggtcattgctttgtgtggacctctacatgataggagttggtaaaaagggaagttggtggtaaagatccttgactttgaggtcaggctgcctccattcacattcttactccacctcttaatgagcacttctgaactgcttcatagttgataaagggggcagagtaatactgtttgtctcctaggttgttgtgaggaataaatgagatgtaaggcaagtgaagcacttagtgtcttggcatgtggttctgctgctgcttactatttgattaccttggtgctttctctccagctatgtttttatctacaattaatatatttcattttgttaaaacagatgaacctgataaatgtgttggcctgtcttaacccaatcctgtagcttttttaatgttgtttatatgttttggactgttagatattttgccgaattaagtatattttatgatctgcaaaaactcaatgaaaagccaggatttcaaaaccctgagcttacatttttgttctctaattacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgaaaatttagtagaaatataaactgctatattctatcccttgaaatcacgtagaacaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattc

SEQ ID NO: 379888 - DNA, 855 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaaccagtcaagttttggaaggcgagcttattcatgatctttaaccattttgtgagtgctaaaatggatcatatgtcagtttatcagaatataacgaattcctgattcctgggctggtacatgaacagaattgcacaagggactacttacttagggaaggggcgaaataggatctttggccatgcgagactcatgggcgtgagggacatggtggggaaaaaag

SEQ ID NO: 379889 - DNA, 614 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgtaagttaagatctgaaagaaactcagtttttctaggtgcttttttcatgttactaacttttaatggtgcagagcaggaattctggaacttgactctcagctgtggctcatattagctgtgaccttgggcaagtggcttgacctttctgtgccctagtttcctcctttgtaatatgaagttgttaacggtacctgccacaggtttgtggtgagagctaacctca

SEQ ID NO: 379890 - DNA, 829 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggcagtttttcagaaagaggacagaatttgagattgtgcttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaaggtttgtttttaatttttttctaatatttcctaataaaatcttttaaatttttcttgtgaattatagagtcgtccctcattatctgaggcaaggaggatttggaaccctcagatacagaaggctgactgtatttatatgttttgaatttcagactacaggacttttaaatagataggtagtggttgtatgtattttgggggcacaggtgatattttgatacatgtatgcaatgtgtaattatcaaatcagggtaattggaatatcacacatcttttctttatgttggaaacattcaacagttctcttctagctctttcaactatacaatacattgttaaccagagtctaagcactgttgttttcaatcttaccttcacacatgctttcagtttgtgtaatctattatacctataaagtaaacctattttgagaaaacctttattttatacataggtgtatttcttaagtgttattacactaaatgcttatagtcttag

SEQ ID NO: 379891 - DNA, 482 bp, Homo sapiens
tgactgtagttaaatagttgctatttatcataattttattaaagttcagactgaatgtgattagcttatttaatgaaagagtcctattttccagcacatttcatttaatggctgagcattggctagaatactaatgacttttatgtctgctttatatagttgctcaggagaattagaaggcttaggatcaatatggtaaagattttttttaaataattatgtaattcttaaattctcttactattctaaattaggtatatttaatcttgcttttaactggattcaaatctgtagtattataaaagaataccagaggctaaaaggttgactaacactgtgtttaatttttcaatttttgtcatagcacacatcggacatttggaaaacagcagtggcaacaactgtatgacacacttaatgcctggaaacaaaatctgaacaaagtgaaaaacagccttttgagtctttctgatacctgagtt

SEQ ID NO: 379892 - DNA, 957 bp, Homo sapiens
  misc_feature (775)..(775): n is a, c, g, or t
  misc_feature (823)..(823): n is a, c, g, or t
  misc_feature (825)..(825): n is a, c, g, or t
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgccccaggtgtttgtccgagcttgaagatccaatgctttcttttgaccccttcttactttaaaccagcagtttgggagggagcttatcangatcttaccatttgggggcaatgggccatgtccgtttccgaaataagntnctggtctgggggtcttgacacaaatggcaaggccctctttggaggggcgacaagaatttgaccgcgccactggcgggtgcgttcccacaggtcggtcccagtcctctggtcatggacaactattttcccaaa

SEQ ID NO: 379893 - DNA, 412 bp, Homo sapiens
atgtcctagtagcgcaagggaccgctgccgagcctgggccgggcggccggggctgacacccgcagctgttctacacgcgagaatggggaggccggtggctggggcgcgcgttcctggcctcgattcgcaccagctcgccggccggcggtcccagcgcggggcccgacgcttcaccgccagctccctggtcggcgtcgggactcatttctgacgacatagtacttttagactgatgaggaatgatgtctgcttccgtccgtcaaatgcagccacattcggagtgggaggtggtgaatctgtagttagcataagcagggtagggaaaagtaattttgtgctaaagatcaaaatgccgggccgggcgcggtggctcacgcctttaatcccagcactttgggacgccgaggcgggc

SEQ ID NO: 379894 - DNA, 1766 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaaaaaaaaaaaaaaaaaaaaaaaacaaaaaaaaaaaagagaggggggggcgcgcggctcaaaaaatctccccaggggggggcccaatatagagggggaccccgcgtttttgggaaacaaggggggcccaaataggggggcgggctataataatacagccgaggaggacgaaggggcggcgggttaaaaaacaaccgccgcggaggcgggcgaaaaaactcctcgtcactgggggcgaatactcgcgggagaaaagcaccccccacccagcgggggggggcgaaacataagtggggggcaaacacacacacccacgaaggaaatattaaaccgcctcacaaggggtaactaacaacacacgtcagagggcgagcagggcgcgtcaacacccgccggaactagactcgcggagggaaaaaaatttgtcggacagcggaatatacttatccgagaaaaatctatacg

SEQ ID NO: 379895 - DNA, 1679 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaaaaaaaaaaaaaaaaaaaaaaaaacctgtgctggcgcgggcctctggcgccctctgagaaaaaagcttctctagagcaccaattccggttggggcgcgccggggcgccgccagcgtggggtacagcgtgagaaacatgtggcgcccaatagcgctgtgttcccaataggaggtgacccgggggctcatagagaaccataggtgcgttgggggttctccctccccaatataaaaaaaagacgccccgggggggaaaccccaagagcgcggttcgggacacaccaatctcccagaagaggagagtccgaaaagaggccaatcagccggggagcttcatatacaacacgcggaggctccaaacggcgaacgcccgaatattaaaaaattacgccga

SEQ ID NO: 379896 - DNA, 2041 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagttgctcaggagaattagaaggcttaggatcaatatggtaaagattttttttaaataattatgtaattcttaaattctcttactattctaaattaggtatatttaatcttgcttttaactggattcaaatctgtagtattataaaagaataccagaggctaaaaggttgactaacactgtgtttaatttttcaatttttgtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctcggaaa

SEQ ID NO: 379897 - DNA, 1643 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacggtaaggcagacagaacattttcatttatttctagaatttctcatctactacatggatcatagtaagatttttatctggaaactgagccttacacaacaaagatttgtttatagcagatgtgtatttagtagattagtggatatatttgttgtagggtgcaaagacgtttaggcaatacaccactgtggttaagagcacagattttagtattagatgtggatttaagaccaggcccttcctttgtgaaacaggaatgtaggggttcatttgtggttgtaagaattaaatgaattaatacaggtaaagcacagtgcctggcacatagtaagtgatctttcaagtgttaaccattaccagtttttttatgattagcctagaaacaagaacttcttccccaacaattagattataaagcaacttaactgctcaggaattttttctgagctttttaaatttgaaagttgggattatgcaattaagattaataaaaggtacagaactattgaccttttttcccctaatgctctaagttttctatgaagaagtaataacttagtaggaaattagtttattcccctatatgagatggtaggggaagaacacctagcattc

SEQ ID NO: 379898 - DNA, 1287 bp, Homo sapiens; identical to SEQ ID NO: 379872

SEQ ID NO: 379899 - DNA, 1286 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaaccagtcaagttttggaaggcgagcttattcatgacttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379900 - DNA, 1287 bp, Homo sapiens; identical to SEQ ID NO: 379872

SEQ ID NO: 379901 - DNA, 879 bp, Homo sapiens
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattgggctcatatgtccacggtttatacacagtatatatagggctaaa

SEQ ID NO: 379902 - DNA, 1840 bp, Homo sapiens
  misc_feature (820)..(820): n is a, c, g, or t
acccgccccaacctacggctaggtacgaggctgggtggttgcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaaccagtcaagttttggaaggcgagcttattcatgacttttaaccattttgngagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaatttgcctagtctggacagttattgtctcaaatttatactaaaatcacaaactccagaggatatgaagtaataaattacaaggggtcacaatgtctgtcatacaatacataaattctgttctttaaaaaaggatattgaagaagcaatgagcactttaaagaaaggataatatacagagagaagacagaagtagagtaatacaatttcttcacattagaaaaacttggaaaagcaaagacaaactgtagagctttaaatacaacagtcattttattctagtaaaaactataccagaatttcagttacataatttcactactgaaagcacttatctacattattttaatctgttgtttttttccaacgtctcttctgcttttcttttctttggctggttgtcattttctaaacttagtaaattttcacttttatttagttgattcgtaatgaggctctgccagtcatcatcaccagaagtatttttagtcgtcttgattgcctgcaaatggctttgtagtggagttgatatcagaggctttgttttcacctcggaaa

SEQ ID NO: 379903 - DNA, 879 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatgaggcacttgtggattgtaagaagagtgatgctgcttcaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379904 - DNA, 1208 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataaagatgttgaaagtgtgatgaacagtgtggtatccctactcttgatcctggaaccagacaagcaagaagctttgattgaaagcctatgtgaaaagctggtcaaatttcgcgaaggtgaacgcccgtctctgagactgcagttgttaagcaaccttttccacgggatggataagaatactcctgtaagatacacagtgtattgcagccttattaaagtggcagcatcttgtggggccatccagtacatcccaactgagctggatcaagttagaaaatggatttctgactggaatctcaccactgaacaaaagtcatggtggaattgctcggaagttacacagaggacaatgcttcccaggctcgagttgatgcccacaggtgtattgtacgagcattgaaagatccaaatgcatttctttttgaccaccttcttactttaaaaccagtcaagtttttggaaggcgagcttattcatgatcttttaaccatttttgtgagtgctaaattggcatcatatgtcaagttttatcagaataataaagacttcattgattcacttggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctgagtttttatgcttataatttttgttctttgaaaaaaaagccctaaatcatagtaaaacattataaactaaaaaaa

SEQ ID NO: 379905 - DNA, 394 bp, Homo sapiens
aaatttaggctaggtacgaggctgggtggcggcgtggtcttgcgagtggagtgtccgctgtgcccgggcctgcaccatgagcgtcccggccttcatcgacatcagtgaagaagatcaggctgctgagcttcgtgcttatctgaaatctaaaggagctgagatttcagaagagaactcggaaggtggacttcatgttgatttagctcaaattattgaagcctgtgatgtgtgtctgaaggaggatgataagcatcagtagttaccgacagaagttattcacaaaagaccaaatatatgattctatctatatgaaatgttcagaataggcaaatatatagagatagaaagagactcaatactgtatgggactgagggactgatgggagaagactgg

SEQ ID NO: 379906 - DNA, 797 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgt

SEQ ID NO: 379907 - DNA, 1121 bp, Homo sapiens
aagaatcaattattgttcatgaggtgcatgtggaaggccacttttataattaaaaaaatgagtttaacagtgaaaccccatctctactaaaaatatgaaaaactagccaggtgcagtggcacacgcctgtagtcccagctagttgggaggctgaggcaggagaattgcttgaacccaggaagtggaggttgcagtgagctgagatcacaccactgcactgcagcctgggtgacagagtgagactcagtctcaaaaaaaaaaaagagtttgtataaatgggctccttctggaggacactctggtcatctgggatcagctggtgtctactgggaagcagaccagttagagaattgcttaatatgaagctagttggttttagaaatcacatagcccaacccctcatgaaagaaccacggcttggataaaattacatagaaaatgaatgacacagactattgggctgagaatgagaacgcgtatcccctcacttttatcgggaacacagctacctgcctcccgagagagtctccctagccaagtttccttgttaatgtgatgagactttactagaatgtctctgtcctgtttatgcttccctgtgctcttccttacatccccttagctcttgatgttataattttaaaatattttcatttcccctaaaggctacaacaacaaaagaaatgtttatagaatttggatgaattatgatttaactatgatcctatttaaaatagtaaaataattagcagactggagaattgcattatttttaattaatattgctgcaattacatattatggcaaagttggaagaactagtactacacaaaacttggggaaaaggtattatgagttatcttttttaatctccgaaatcaaagtttaaaaattctaaccaattatgtattttctagagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgt

SEQ ID NO: 379908 - DNA, 2962 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatatctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379909 - DNA, 4005 bp, Homo sapiens
atctttatcagtgctaaccagtgtgcatgttcttgcttggaaaaaccttgcgggaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaagggtaagattcatgggaggcagggacatgcttgctgtgtgtccagaggtaaccctgagcactagagaaactctctttgctgccttccacctaatggctcatgaaaaagggcccagtagatccatttttcagagagtggccagggcagactcacacttcccacaaagggttatttcttctccacgtagtatttggtacaaaggataaaaatcaaatattctgggcaaatgaactatactaaggtaccacttctgtgtggatacagtccctgtgtgaacacaaactgtgcagtcacataaggaggccctggtcctgccccagagcacaatttgtccttgacttctcctgtaaccagtggttgtgggccccacatctccttagagaagctagcgttagctcatactggaccctctttgcctgtgattattcaatatccaagccacacacttaagcaacttttcagcttctcagaatacccttcctctgccagctggatctttaataccactgagattaaatactgatttctggggctttatgataaagacttcacgtctgagcctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379910 - DNA, 3135 bp, Homo sapiens
tttagagcaagctaacagctaaacttcagttcttccacttgcgaaataattattattaaaatccaatgatgaacaaaataagatgaattacagcagaagagatgacctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379911 - DNA, 2827 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379912 - DNA, 2914 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379913 - DNA, 1045 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgt

SEQ ID NO: 379914 - DNA, 3903 bp, Homo sapiens
atctttatcagtgctaaccagtgtgcatgttcttgcttggaaaaaccttgcgggaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaagggtaagattcatgggaggcagggacatgcttgctgtgtgtccagaggtaaccctgagcactagagaaactctctttgctgccttccacctaatggctcatgaaaaagggcccagtagatccatttttcagagagtggccagggcagactcacacttcccacaaagggttatttcttctccacgtagtatttggtacaaaggataaaaatcaaatattctgggcaaatgaactatactaaggtaccacttctgtgtggatacagtccctgtgtgaacacaaactgtgcagtcacataaggaggccctggtcctgccccagagcacaatttgtccttgacttctcctgtaaccagtggttgtgggccccacatctccttagagaagctagcgttagctcatactggaccctctttgcctgtgattattcaatatccaagccacacacttaagcaacttttcagcttctcagaatacccttcctctgccagctggatctttaataccactgagattaaatactgatttctggggctttatgataaagacttcacgtctgagcctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379915 - DNA, 3092 bp, Homo sapiens
aagaatcaattattgttcatgaggtgcatgtggaaggccacttttataattaaaaaaatgagtttaacagtgaaaccccatctctactaaaaatatgaaaaactagccaggtgcagtggcacacgcctgtagtcccagctagttgggaggctgaggcaggagaattgcttgaacccaggaagtggaggttgcagtgagctgagatcacaccactgcactgcagcctgggtgacagagtgagactcagtctcaaaaaaaaaaaagagtttgtataaatgggctccttctggaggacactctggtcatctgggatcagctggtgtctactgggaagcagaccagttagagaattgcttaatatgaagctagttggttttagaaatcacatagcccaacccctcatgaaagaaccacggcttggataaaattacatagaaaatgaatgacacagactattgggctgagaatgagaacgcgtatcccctcacttttatcgggaacacagctacctgcctcccgagagagtctccctagccaagtttccttgttaatgtgatgagactttactagaatgtctctgtcctgtttatgcttccctgtgctcttccttacatccccttagctcttgatgttataattttaaaatattttcatttcccctaaaggctacaacaacaaaagaaatgtttatagaatttggatgaattatgatttaactatgatcctatttaaaatagtaaaataattagcagactggagaattgcattatttttaattaatattgctgcaattacatattatggcaaagttggaagaactagtactacacaaaacttggggaaaaggtattatgagttatcttttttaatctccgaaatcaaagtttaaaaattctaaccaattatgtattttctagagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379916 - DNA, 2181 bp, Homo sapiens
ctcctagagtatccccacgtaatatgtaaccaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379917 - DNA, 1425 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgtggtaggagtcaatgaagacatcttagtcttaacaagttacagataatctctgactggcatgttttctgcttctagcttggagctaaatgctgctcatgctgcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379918 - DNA, 1883 bp, Homo sapiens
atctttatcagtgctaaccagtgtgcatgttcttgcttggaaaaaccttgcgggaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaagggtaagattcatgggaggcagggacatgcttgctgtgtgtccagaggtaaccctgagcactagagaaactctctttgctgccttccacctaatggctcatgaaaaagggcccagtagatccatttttcagagagtggccagggcagactcacacttcccacaaagggttatttcttctccacgtagtatttggtacaaaggataaaaatcaaatattctgggcaaatgaactatactaaggtaccacttctgtgtggatacagtccctgtgtgaacacaaactgtgcagtcacataaggaggccctggtcctgccccagagcacaatttgtccttgacttctcctgtaaccagtggttgtgggccccacatctccttagagaagctagcgttagctcatactggaccctctttgcctgtgattattcaatatccaagccacacacttaagcaacttttcagcttctcagaatacccttcctctgccagctggatctttaataccactgagattaaatactgatttctggggctttatgataaagacttcacgtctgagcctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgtaagtataaggaccatcaaatctcagctggttggaattgaaggaacgtcagagttaattcttctagtttaaaaatccctattttacaatttagagagaaaaagcttagaacaggctaggaagcccaggttttcctggctgtcccattggtagaaccaagagtagagcccaaatttcttgccttctagaccagtgctctttcgtctacacaatgttgctcctggattatattccaagcttggaggaggtttacctcagttatttaaagagtgtacatttttaaatgtaccatggactctttatagcttgtaaccttgaccttgaatatggtcgccaatcccggggagagcctacagatcctt

SEQ ID NO: 379919 - DNA, 890 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacagtgagtagtttcagactgaatatcctgtcatgtgaaagctctgtgtctcccctttgcatactctctgcttttctggcagtctctggttggtcggtctgaatgcctggagacagacagaaataaacaaaaacttgtggttggaaaaaaaaag

SEQ ID NO: 379920 - DNA, 1932 bp, Homo sapiens
atctttatcagtgctaaccagtgtgcatgttcttgcttggaaaaaccttgcgggaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaagggtaagattcatgggaggcagggacatgcttgctgtgtgtccagaggtaaccctgagcactagagaaactctctttgctgccttccacctaatggctcatgaaaaagggcccagtagatccatttttcagagagtggccagggcagactcacacttcccacaaagggttatttcttctccacgtagtatttggtacaaaggataaaaatcaaatattctgggcaaatgaactatactaaggtaccacttctgtgtggatacagtccctgtgtgaacacaaactgtgcagtcacataaggaggccctggtcctgccccagagcacaatttgtccttgacttctcctgtaaccagtggttgtgggccccacatctccttagagaagctagcgttagctcatactggaccctctttgcctgtgattattcaatatccaagccacacacttaagcaacttttcagcttctcagaatacccttcctctgccagctggatctttaataccactgagattaaatactgatttctggggctttatgataaagacttcacgtctgagcctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgt

SEQ ID NO: 379921 - DNA, 1558 bp, Homo sapiens
atctttatcagtgctaaccagtgtgcatgttcttgcttggaaaaaccttgcgggaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaagggtaagattcatgggaggcagggacatgcttgctgtgtgtccagaggtaaccctgagcactagagaaactctctttgctgccttccacctaatggctcatgaaaaagggcccagtagatccatttttcagagagtggccagggcagactcacacttcccacaaagggttatttcttctccacgtagtatttggtacaaaggataaaaatcaaatattctgggcaaatgaactatactaaggtaccacttctgtgtggatacagtccctgtgtgaacacaaactgtgcagtcacataaggaggccctggtcctgccccagagcacaatttgtccttgacttctcctgtaaccagtggttgtgggccccacatctccttagagaagctagcgttagctcatactggaccctctttgcctgtgattattcaatatccaagccacacacttaagcaacttttcagcttctcagaatacccttcctctgccagctggatctttaataccactgagattaaatactgatttctggggctttatgataaagacttcacgtctgagcctgctcttcccactttcctcgactcccattctgactcaagcaacatacaccaataacttccagtccatgtgtttctgcaccttgtcccatcagagcctctttcctgagtgcttctgttggctgttccaatctctctgtccattcaagtcattggtccatctcaacctcctctctttcaaccctgtaatttagtaacactcttctccttcccaggtacaccttttctccaggcctcctcagttcctagtgatttccactaaaacaaatccaacccctctgtgcatctgcatgtcattcaaagtcaatatagacattcttatatcaggtgggaattaggcctatctagcaatatagatccacaagatttctgcagtgttctctccctaaaagttttccaacatcactttttgattgagtgattgacagtgacatggtgggcacatttccacaagacaactgaactgatcatttctctctcttctgggcagtttggcattactggatccctctcaattatctctggaaaacaatcaactaagccctttgacctgagcagcttgagatggaccaatgacgtcgacg

SEQ ID NO: 379922 - DNA, 734 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttggggtaagtccacctcattataaggggaatactgagaaaatactttgtaaatgtatctagactacagatctacagtgggtctgggaaactctttcactcttttctggctgactccaggctaatgaggacatgaaatggagctttaagggaagactcttaaagctctgcagcagtttctagaaactaaaaccactagatctttttcactagcatgcttcacaattaacaggttagtctttcttattttatttatttatatatttatttattttgagacagaatctccctctgtcacccagcatggagtgcagtggcacgatctcagctcactgcaacctccgcctcctgggttcaagtgattcttctgcctcagcctcccgagtagctgggactatgggtgcacgccac

SEQ ID NO: 379923 - DNA, 471 bp, Homo sapiens
cccatttttaggagctctgtgtgtgagtagaatggggactctaagaggggacatgctttataaatgctaaccaggtgcatagtcgtggagtgactcagactccaagaggccaggaggcaaaaggcggcaaggcctcgactttccttctatcattgccccacgtcacatttcccctattcaagaagagcagcagagagacttaatctgtcttcctgcagagcagggggcaagagggaatggtaatacaatgggtataccagcacaggatttcttacctggcattacagcatacctctagaaaagtggatgattttccatatccctctttgaggctttgatgaggccattggattccctccattgtaagaataatcaacttttcaggtagagagtgagaaggccatttttaaacaataaaacgagcaccactggttgatgccacaggtttgcagagatttggattaacaaggg

SEQ ID NO: 379924 - DNA, 3016 bp, Homo sapiens
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379925 - DNA, 3438 bp, Homo sapiens
  misc_feature (3352)..(3352): n is a, c, g, or t
  misc_feature (3414)..(3414): n is a, c, g, or t
attcacatcctgtgtaatcataaatactgctctaagaaagggacaggaagtctcagaggctggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaaaaaaaaaaaaaaaaaaactcgagactagttctctcctcgtgccgaattcggcacgagacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagcttggttgtccaagatagattcttagttcaactttaaatttgcccacagaaccctctaaatccccttggtatttaactggttagtccaaagaggaacagctctttggacactangaaaaaaccttgtgaggagagtaatttaacacccatagtaggcctatagcagccaccattanggcggtaagctaacacccactcct

SEQ ID NO: 379926 - DNA, 2870 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379927 - DNA, 2893 bp, Homo sapiens
atgacacagaattgtgccaaggggcaggacagaaggaggagtcagcccccggagcagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379928 - DNA, 2819 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacagctttacaccaaagggcatcactatccctcaaagagagaaacctggacacatgtaccaaaacgaagattacctgcagaacgggctgccaacagaaaccaccgttcttgggtttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtatttgtttactatgagtcgttatttaatttctcttgaaaataatttcctcaaagcccaagtcagtaaaatgttatcagccagtcttccaaaatggtcataaactttataaactgctttgggtaaactgagcagaaggtgatacacagaagggaaaatgtgcactcatgctagtgtgaatttggtaagtcgcgtgactctgcaggctgtttctgtattattttcacactcatattgcttaaatattacatattagggattgtaagaaaactttaattaaaaattaaagactatatataattaaactactctgccctggacactctctgagaaacagatctactgggccctttttcatgagccattaggtggaagacagcaaagagatcttctcaagtgcttaggattacctctcaacacacagcaagcatgtccctgcctcccatgaatcttaccatgtaaatccaaatctctgcaatcctgtggcaccaaccagtggtgctcattctattgtttaaaaatggccttcttggctgggcgcggtggctcactcctgtaatcccagcactttggtaggccgaggtggacggatcacccgaggtcaggagtttgagaccagcctggccaacaaggtgaaaccctgtctctactaaaaatacaaaaaattagccaggcatggtggtgcgcacctgtagttccagctacttgggaggctgaggcagaagaatcacttgaacccgggaaggggaggttgcagtgagcggagactgcaccactgcattccagcccggcctacaagaacaaaactccatctcaaaataaataaaaaaataaataaaaataaaaatagactatatatagtctttgaattcatttattttaaataaatgaataaaataaaataaaaaagaatattcagtcgttggcacataaactatgttctcttctgtcatttcagggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379929 - DNA, 1367 bp, Homo sapiens
atgacacagaattgtgccaaggggcaggacagaaggaggagtcagcccccggagcagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgtggtaggagtcaatgaagacatcttagtcttaacaagttacagataatctctgactggcatgttttctgcttctagcttggagctaaatgctgctcatgctgaaaagaataatgtctatttctttgtttgggtattagctctattttgatctatagcacagttttgtaattcagatcatcacccctgcactttgtaccacatgggcgtattctttcttcccagtcattgctgcaattatcttgtctgttctttgtgtaatatgttctgtgtgagcctctgcattaaactcgatttcttgggcaattatggaaattccagtgtggctgcagtttaactttgcactctctatgcatatgaggtttcctaaataaatgaggagtagcatagtttaaaatatatatatcttataactttctacaacaaagaattattgagtccaaatgtcatcagtgctcattttgagataccctgctatcgatggtcgctacaaaccaggaaatactcaagttattatgtgtatacattggttttagttttatgaaacaatttaccttcatgatctcatagttaaaattgtaataaatttaggaatataaaggatcaatatgggaagcaaaatttctaaaggcagtttctgttgttttaattagtatttgtgtagttcaaaccaggaaggatttgactatcattagattttgcttaactttatgaaagctaaaatattctctgttataaaggggcaactccatctggtcctatagcatctttactactgatttttttttgtttaatttgaaaatgcaaagaattgttaaatgttcttaaatgttctcactacaaaaaaagaaaaaagataactacgtgaggtgatggatatgttaattagctggattgtggtaatcattttggaatgtatatgtatatcaaaacatgtagtacaccctaaatatatataatttttatttgtcaaatatacctcaataaagatggaaaaaaatcgaaattcaaagttatc

SEQ ID NO: 379930 - DNA, 881 bp, Homo sapiens
  misc_feature (4)..(4): n is a, c, g, or t
  misc_feature (17)..(17): n is a, c, g, or t
  misc_feature (19)..(19): n is a, c, g, or t
  misc_feature (23)..(23): n is a, c, g, or t
cagnagcgcgccattgngntggnaccccggaattcggccattatggccggggagagcagagcaccaagatcgttctggcaggaacagccagtgggaggttccagctgagcgctccccagaggtgagctgatccccagccacagcacacaggaccaggctgcgagaacaggtagacaccttggtttagatcatgacttttggggaagattgtgtgcttttgaaaagacagccagggaattggattatcatcctgtctctgattctgaccacctgtgtgagttggagcgtcagctcagtcccctttttgggtctcagtttactcacttgtcaaataagaaaattgggtaaaaccattcttaggtttccctcattgaggtgattttcctcaatgttctgcattctcctggtgtgtcactcagtcttacagagtctactctcaacaaatactgtgcaattagactgaatcttgcattagaaccccatggtcctactctaattctgtaatacagaaaattgctgggcagagctgttgacctccatgtcatgatttatcttcaaagcacggattttagagctgtcttgaaagctgtgggtccctccagtctatctcctcaaggcgaatgtggaaggacaaagcatcctctcagactgtggtgtttggagatgatagcatcagtctggagacttttgtgaaacataaagaatcttggttatataggattccttctaaaagtagcaacgtgtatctaaattcaagtgtcatagatttaaatgtaataattccacttccatacatcactgtgagataattaaatgcaggaggtatcacaaaagtgcaaagatgttcattattgcattgttcatagtggcaaaaagaaaaa

SEQ ID NO: 379931 - DNA, 2031 bp, Homo sapiens
ctcttaatacatcacctaatatttccaaagcccccccccccagtcactgtcatctggtcatcctctatcttctcacaatactttttcctcatagcactaaatagtacctgtcctcatattaagtgtctgtttattatctgcctccttccctggaatgtaagcttcatgagggcaggagtgcagttttgtttattactgtaacctcagagtagagaagcctggccacatagtagatgctagtattcgtttcctagggctgctgtaacagataccatacatgagttacttaaaacaacagaaatttattctttcacagtttaggtggccagaagtcccaaaccaagatataacaaattatatctgcaaagcctttatttccacagaaccacattctgaggttctgggtggacattaatttggcagggagtagtggggggacactaacctactacagtgctcagtaaatatttattgggtgaatgaaaattcagagtgtattctaagctgtaaaccccttggatgttttcatcacagtcttctcttaataactgctacagaacataaggattagtttgtggtcccagattttttaggctccaattctgcttctaccacttttctacttgtgagctcttaggcaagctattttaactttgtaagccttcagtttcttctgtaaaatggtgacaataagaaataacagtaagtgcccaataagttttaactattattatgtgtctatagctattttaaagcactttctatatgtaatcctcataacaaccgtattaggtgagcctattacacttctcattttatgacaaaggaaactagatttgtttcaagaatgaaaaacctagaaaattatatgtcactttatgaagtgcctggcacatagtacatagaatagcttagctacaataatatagatatgtgactttacctcataactttaagacatctcaaattgattcacaaatcagaaaaaaaatctgaggcatcagatgtgaggtgaggtgaggtgaggcatctcagtttttgcacatatggttactgttattgagggagctccatgtcattgagggagctccacgtcattgagggaggactgggtgggatgctggccaaaggtaggggcatatttaggcagtgaaattgcagttatgggacccctctatagcactagatgtgtgagaggactaaaaataaaattcctttgaaatttcttacagggtcatatattacctccttcccaatgactactgtggtatattagagtaggggattgatgtcccagaaatattatgtacatcaaacagaagatctacacaaattgttttatcagatactgaatatatcaatgggctagagtgtattatagtacatatgggtatgttgttttcccccttttgactaaataaactctcccctctctgcaacaggtaaatttccagtttacctttttcttgctgtttttaattttttttattttgaaggctttgtatctttatatctcagctgaaaatattacattctaactccccaaagctattctcacattatttgcaagtattttttcatagtttacatgtttgtgtatttgtttaatacattccacaagactgaaagtcttggtgagggcaggaactctgtctaggttgttcatctggcagccagcaaacccaaaataagtattagttgaatgaatagctaaatagatgagccatggggtagcatatctgttttagctactgcttgcctgttatcatcctgggatgctgcttgcttctccgtgatctcttcttgttcttaaattgtcttcagttgtagtactaagtactaatttgatctgtaatgtgatatgtggctgaagtttgctctgtaaaatcaccgtttcctgaggtatattcaatacctttaatttttccataaatctcttcaaggtttgtgtgtgttttcttttaaattatctaactagttggatgtatgcttgaagtgctagacaataaaagtttcaataggctagaaatg

SEQ ID NO: 379932 - DNA, 1556 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggtgaagtcttgctctgtcacccaggctggagtgcagttgcgtgatctcagctcactgcaacctccgccttctgggttcaagcagttctcctgcctcagccttccgagtaactgggactacaggggttcaccactacacctggctaattttttgtatttttagtagagataaggtttcaccatgttggtcaggctggtcttgaactcctgacatcaagtaatccatccgcctcagcctcccaaagtgctgagattacaggcatgagccactgtgcctggccctgagcttaaaataaaagttaaattaaaaaaaaaataatgttgatgttttcatttttgcaatcaatagcttagttagactcaaattgcaaactgtcattgcctgtagtaggcagtggcatagaactcaattcagctcttttaacctgagttttaagctgctttcagattgccccacacatacatggttcaggagtcagccagagacttgggctgagtttaaacatagaatctggggttgtcctcttctggctgtcttctttcttgggcatctgcatcattctctagcacctatggtttttccaggctctttcccccagtttcctccagtcagaaagatggcaagagtttttgctgcctgccctcccccagtccttgtgccaacaccaccaccattgcagctgcctccagggaaaaactgcaaaaaccaaatcacttgctccaggtgttgactcctcttcaaaatctatttttgttaaatctccaaagcctcaaataggttttcttcctagaatttatatctgttatttgtagcaggattggtctgtaaggcactcagtcttctacatcatgggtcagcagattacagcccttgggttaaatccagccacctgcttgttttattaataaagttttgttggaactaaacc

SEQ ID NO: 379933 - DNA, 185 bp, Homo sapiens
tggcatatgaaaatttattactacagtgttttcaccattaatatttatgatcttggtctttccttcttgcctttgtatagggccaaaagagaaacattggctactttgacaaccttaaagcggaaagaccaagatcataaatattaatggtgaaaacactgtagtaataaactttcatatgccga

SEQ ID NO: 379934 - DNA, 1684 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctga

SEQ ID NO: 379935 - DNA, 2336 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagtaagaaacaccatcaagatacattggcttctactctgattttacaaagtgaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaa

SEQ ID NO: 379936 - DNA, 1766 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagtaagaaacaccatcaagatacattggcttctactctgattttacaaagtgaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgttaaaaaaaaagaaaaaagaaaagaaaaaaaaaaaaaacagaaaaaaaaagaaaaaaagaaaaggaaaaaagcaggcgagaaacaaacaaagaagacaaacaaggaaaaatacgaagaaaaaagaaacagagaaagaaaggagacagaaaaaggcggagggggcggcgtcgagaaataagtatcccaccaccagggggcgcggccaaacaagtcgacgaccgaccaacaccttgtataaggacgagaaagggccgcccactaaaggggggggttgctaaatcatacagagcacgggcgggggcgggtgataacaagaaggatgtgaggacagcacgcactccttcgcgcgagtactgctgtgggcaccaacctccttgggggggagaaacaggggaacagcacacg

SEQ ID NO: 379937 - DNA, 1851 bp, Homo sapiens
atgtggtatacagacatcttgcttatgcagactgctctctagctgtggtttcttatcttcagaactctgcagatgctggtcagttattctctggtcatgaaagttgcagtggcttgtgaggctggactgatggttctcagttttgaggctttcgagctacccttggatgattgtgaagtgattgaaactgcagcagcgtccgaagtgattaaatatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaa

SEQ ID NO: 379938 - DNA, 1316 bp, Homo sapiens
gcgtccgggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacagggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaacaacagaaggtacgatagagttgaaatactcacctcaataaagttcaagcaaccgtcattgggtacaaaggctgtgattttcttgccattcttgatcagctggacccttacacacttcctaatggcagaatttggctgtttggcttcaactcctctgaaatacaaaaggcacagcactgtgagctggctttctgaaaaagattatcttttcatattaactagagaactaatgagaaactgtttctatcttttcaatctaacctcaaatggctgagctgaactcctgtgatgtcaacctagttttctgccagtcttaatttcattagcacaatgggggaaatttctagaccttttacagttataaaagtagactggagtggcagcgtgggcctgtagtcccaactacttgcgaggctgacgtgggaggatctatgcctagaacgtcaagatggccagcctgtgtgacaagggaccctatctcaaaaaaaaa

SEQ ID NO: 379939 - DNA, 790 bp, Homo sapiens
tggcatatgaaaatttattactacagtgttttcaccattaatatttatgatcttggtctttccttcttgcctttgtatagggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaacaacagaaggtacgatagagttgaaatactcacctcaataaagttcaagcaaccgtcattgggtacaaaggctgtgattttcttgccattcttgatcagctggacccttacacacttcctaatggcagaatttggctgtttggcttcaactcctctgaaatacaaaaggcacagcactgtgagctggctttctgaaaaagattatcttttcatattaactagagaactaatgagaaactgtttctatcttttcaatctaacctcaaatggctgagctgaactcctgtgatgtcaacctagttttctgccagtcttaatttcattagcacaatgggggaaatttctagaccttttacagttataaaagtagactggagtggcagcgtgggcctgtagtcccaactacttgcgaggctgacgtgggaggatctatgcctagaacgtcaagatggccagcctgtgtgacaagggaccctatctcaaaaaaaaa

SEQ ID NO: 379940 - DNA, 605 bp, Homo sapiens
gcgtccgggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttaggtaagaacatgtctgaagctaaaagtaaatttataacatttacatataaagcaaaaagcatatttggaaaattattctccagaggaaaaaaaataga

SEQ ID NO: 379941 - DNA, 832 bp, Homo sapiens
gcgtccgggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggtaagaatggaaatgtttgttttctgtctcaaaagaggattttttgttttgttttgttttggtttgttgacaggtaaaacctccataattgaaattaaggtatgaaaactggtttgatttagtaaaagtcttaaattgaagaatgtcttacaacagatgtccattttcttacttcaactatatatattgattattatcaggctaatgaagtattattttgaaaagtccttacgtaacctgcttaatttaatagataaaaattagcatattaattatctgaatgtaaacagatgtttctgtggtgcttcaaatcatcaatcctaagttaatattcttaggaaactactttcgtctggagagtaaaaagacaatcttgaaaccaaaccataaacaatcacaaattctgaaatattgaggactgtattaattgggaatttcctattaatataaacatatttcaaaatattttttcttttttgagatcatctcactctgtcccccacgctggagtgcagtgagacgagatcgggtcattggattccaacctgggggacagagtgagattggttcc

SEQ ID NO: 379942 - DNA, 404 bp, Homo sapiens
aacggtgccaccatgatttagaacttcccacaggctaatgaagtattattttgaaaagtccttacgtaacctgcttaatttaatagataaaaattagcatattaattatctgaatgtaaacagatgtttctgtggtgcttcaaatcatcaatcctaagttaatattcttaggaaactactttcgtctggagagtaaaaagacaatcttgaaaccaaaccataaacaatcacaaattctgaaatattgaggactgtattaattgggaatttcctattaatataaacatatttcaaaatattttttcttttttgagatcatctcactctgtcccccacgctggagtgcagtgagacgagatcgggtcattggattccaacctgggggacagagtgagattggttcc

SEQ ID NO: 379943 - DNA, 614 bp, Homo sapiens
gcctggctaactgtattttagtttgtatatagacagagtcttgctgtgttgaccaggctggtctcgaactcctgggttcaagctgtcctcctgctttggcctcccaaattgctgggattacagatgtgagccaccacgcctggccaaaaccattttttagtggccttgaggccattctacatcccaaattttggtttattgacagaaataaatcaattggcagaattcctttcaatataattctaaagttgatgctaatacttagtttttgttatcatttaacatggaagaagatgagttcattggagaaaaaacattccaacgttattgtgcagaattcattaaacattcacaacagataggtgatagttgggaatggagaccatcaaaggtaagaatggaaatgtttgttttctgtctcaaaagaggattttttgttttgttttgttttggtttgttgacaggtaaaacctccataattgaaattaaggtatgaaaactggtttgatttagtaaaagtcttaaattgaagaatgtcttacaacagatgtccattttcttacttcaactatatatattgattattatcaggctaatgaagtattattttgaaa

SEQ ID NO: 379944 - DNA, 454 bp, Homo sapiens
acaggaatggatagttttattttagtactgatattcttaaataagtctttactgctcagttatttttcttttattctcttggcttttgttttatgttcttcagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtt

SEQ ID NO: 379945 - DNA, 1438 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggtgaagtcttgctctgtcacccaggctggagtgcagttgcgtgatctcagctcactgcaacctccgccttctgggttcaagcagttctcctgcctcagccttccgagtaactgggactacaggggttcaccactacacctggctaattttttgtatttttagtagagataaggtttcaccatgttggtcaggctggtcttgaactcctgacatcaagtaatccatccgcctcagcctcccaaagtgctgagattacaggcatgagccactgtgcctggccctgagcttaaaataaaagttaaattaaaaaaaaaataatgttgatgttttcatttttgcaatcaatagcttagttagactcaaattgcaaactgtcattgcctgtagtaggcagtggcatagaactcaattcagctcttttaacctgagttttaagctgctttcagattgccccacacatacatggttcaggagtcagccagagacttgggctgagtttaaacatagaatctggggttgtcctcttctggctgtcttctttcttgggcatctgcatcattctctagcacctatggtttttccaggctctttcccccagtttcctccagtcagaaagatggcaagagtttttgctgcctgccctcccccagtccttgtgccaacaccaccaccattgcagctgcctccagggaaaaactgcaaaaaccaaatcacttgctccaggtgttgactcctcttcaaaatctatttttgttaaatctccaaagcctcaaataggttttcttcctagaatttatatctgttatttgtagcaggattggtctgtaaggcactcagtcttctacatcatgggtcagcagattacagcccttgggttaaatccagccacctgcttgttttattaataaagttttgttggaactaaacc

SEQ ID NO: 379946 - DNA, 2286 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaa

SEQ ID NO: 379947 - DNA, 1543 bp, Homo sapiens
gcgtccgggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctga

SEQ ID NO: 379948 - DNA, 2006 bp, Homo sapiens
gcgtccgggccgagcggagagggtagagacggggtttcaccgtgttagccaagatggtctcgatctcctgacctcgtgatccgcccgcctcggcctcccaaagtgctgggattacaggcgtgagccactgcgcccggcctgttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtccattaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactgatgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcgggaaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaa

SEQ ID NO: 379949 - DNA, 1555 bp, Homo sapiens
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataaggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaacaacagaaggtacgatagagttgaaatactcacctcaataaagttcaagcaaccgtcattgggtacaaaggctgtgattttcttgccattcttgatcagctggacccttacacacttcctaatggcagaatttggctgtttggcttcaactcctctgaaatacaaaaggcacagcactgtgagctggctttctgaaaaagattatcttttcatattaactagagaactaatgagaaactgtttctatcttttcaatctaacctcaaatggctgagctgaactcctgtgatgtcaacctagttttctgccagtcttaatttcattagcacaatgggggaaatttctagaccttttacagttataaaagtagactggagtggcagcgtgggcctgtagtcccaactacttgcgaggctgacgtgggaggatctatgcctagaacgtcaagatggccagcctgtgtgacaagggaccctatctcaaaaaaaaa

SEQ ID NO: 379950 - DNA, 984 bp, Homo sapiens
atgtggtatacagacatcttgcttatgcagactgctctctagctgtggtttcttatcttcagaactctgcagatgctgatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataaggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaacaacagaaggtacgatagagttgaaatactcacctcaataaagttcaagcaaccgtcattgggtacaaaggctgtgattttcttgccattcttgatcagctggacccttacacacttcctaatggcagaatttggctgtttggcttcaactcctctgaaatacaaaaggcacagcactgtgagctggctttctgaaaaagattatcttttcatattaactagagaactaatgagaaactgtttctatcttttcaatctaacctcaaatggctgagctgaactcctgtgatgtcaacctagttttctgccagtcttaatttcattagcacaatgggggaaatttctagaccttttacagttataaaagtagactggagtggcagcgtgggcctgtagtcccaactacttgcgaggctgacgtgggaggatctatgcctagaacgtcaagatggccagcctgtgtgacaagggaccctatctcaaaaaaaaa

SEQ ID NO: 379951 - DNA, 388 bp, Homo sapiens
cacgatgatctctgtggtcagggaccacgcagaagactcacatcatgttggtggtgggcccaacaatatgtcacaatgttttctgagaagaaggtcaaggaaagacagacctggaaataccccagtaaaaggctaatcagaatctcagaaaaattgcaaccattagtcctttatctacctatgacctggcagctcccgccctgcttcgagttctcccactttcctggacaatgtacaccttccatatatcgattaatgtctcctgactcctaaaatgtataaaatcaagctgtgacccaaccaccttaggcccgcgttgtcacgacctcgtgaggcggtgtcacgggtgtgtctttaatcttggcaaaataaactttctaaattgaga

SEQ ID NO: 379952 - DNA, 694 bp, Homo sapiens
gaggcagcaggtctcctctgctgtctggagaatgctccagggaagtggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggggaggccagggtgggcagatcacctggggtcaggagttcgagaccagcctggccaacatggtgaaaccctgtctctaccaaaaatacaaaaattagccgggcgtggtggtgggcgcctgtaatcccagctacatgagaggctgaggcaggagaattgcttgagcccgggaggtggaagttacagtgagccaatatcgcaccatagcactttagcttgggtggcagagcaagactccatctcaaaaaaataaaataaataaaaagcatttgcttctgaaa

SEQ ID NO: 379953 - DNA, 414 bp, Homo sapiens
tcccgggtcacccccaaactagggagccaccagactgacacctgaggcagacggtgctttcccaattccaaaaggaagtcactttcattacaggacattggaaaatggagaaaaatgtgaagacaagaaattacccatcacttcaagaacaagagagaaatcactgtgggatgttttgctcccttctttacctacctcatttatataagtgagtattatatatacacacaatgtatgtgacgtgtattgtgtatacacacattatatatgtgcacaacatatactgctctttcacgtacgtaatgagcatttcacaatttcagatccgtgtaagcatgtgtgtcaggcaaacacactgctaaactatcactaattgaatcacgttcttattgtagggttggaataggggttgga

SEQ ID NO: 379954 - DNA, 399 bp, Homo sapiens
gaaactgcttggaacagattcagaggcatcccctgcaggcagcctctggaggagtgtgtgggagggcagtgcaggggatgccactgaaataaaactcccaaaaagaaaccaaaaactcggccaggcgcggtggctcatgcctgtaatcccagcactttgggaggctgaggcagatggatcacgaggtcaggagatcaagaccatcctggccaacatggtgaaatcccatctctactaaaaatataaaaattagctggctgtggtggcacgtgtctgtaatcccagctactcaggaggctgaggcaggagaatcatttgaaccagggagtcagaggttgcagtgagccgacatcgtgccactgcactccagcctggcgacagagcaagactctgtcttaa

SEQ ID NO: 379955 - DNA, 560 bp, Homo sapiens
cacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactg

SEQ ID NO: 379956 - DNA, 402 bp, Homo sapiens
atttgtaaagctctgtataacttggctctaaagcaggctatcattattattagacagtatttagtttttagactttacttgtcctggccatcccattgtgctggtattataaaacatagctactgtgcagttaccaaattgattgtggcaatgttagtaatactgtgtataattataatttttcctttttagtagagggaaaggaaatgtcacaaaaaggtctcacctggtatgctgtatttttacatccttaggaacagtttaactgaaaagtagtagtttaattaccactatttcacagcatagaaatacacataaggttttgaagtttgcatctggtaattactctgttagcactcagacttggggagatgatatttcttccttgcaaggagttatata

SEQ ID NO: 379957 - DNA, 389 bp, Homo sapiens
gccacgaattagaagacttaatattgttaagatgtcagttcttctgaaattgatcaacagattacttgtaatcccaataaaaatttcagcaggctgtttttgttttggtataaattagtaacatgattttaaaattctaagctgtggctgggcaaggtatctcacgcctgtagtcccggcactttgggaggctgaggcgggcagttcaccttgggtcgggagcttgagaccagcctggccaacatggcaaaaccctgtttctactaaaggtacaaaaattggctgggcgtggtgttgggcacttgtggtcccagctacttgggaggctgaggcaggagaatcacttgaacccgggaggcagaggttacagtgagccgagttcgtgccac

SEQ ID NO: 379958 - DNA, 322 bp, Homo sapiens
gcggaggttgtggcgagccatgatcgcgctgttgcactccagcctgggcaacaagagcgaaactccatctcaaaaaaaaaacaaaagacaaaacaaacaaaaaaaaaccttttatcttctgatttaatgtggcaaatatgagaagaaattgaaatgccaaccaaaatgccattgtagagtttataatcccatgttttttggccgtcccctgttacctctcctagataaacaggagttgaatgtcttgtgtcctggatttttatgggtctcttaggttactacaataacaagatcactcaatcccgtggagtctgtcctatta

SEQ ID NO: 379959 - DNA, 333 bp, Homo sapiens
tgatggggctagtcgccctcataactctctcttttcagtatttttctagctgttcttttgtgttcatttttctatatgagaattttagagtcaatgcatgtagctctctaagcaaaagtgttttctctggtccctttacatccaagtttcttaaaagactgtttaatactgattttaattcctctccatttccttctttagtcctctcaaagattcctttgtccattgtgatagcattaaatttgtaaatttgagtacaattaaaataactctgccaaaaatatgtcagtaactgattcctctgcagtgattatgatttaatcagattgacgt

SEQ ID NO: 379960 - DNA, 447 bp, Homo sapiens
agtttccaaattctagagaaaacaggtagagagagactaatatgctccaaagtttgttcacaggaatatactttactcaatttttaaaagctataaatagctcaaaggaaaagttttcttgattccaaagtcagccaattgtggtgcttcggtctatttcctttgggttgggagtctcctcagtttagttgcttcatggtttgccaggaagatgttactggaaaggggtcctgatccagaccccaagagagggttgttggacctcacacaagaaagaagttggggagagtccattgagaaaagtgaaagcaagtttattaagaaagtaaaggaataaagaagggctactccataggcagagcagccaggagtttctttttgggtgatgaaaatgttctgaaattaatggcaatggttgcacagttctgttaatgtaccaaaaaaaaa

SEQ ID NO: 379961 - DNA, 420 bp, Homo sapiens
agccaccgtgcctggcctgcttgttgttttcatctcatcctgatttccaaatacaggagagaagctgaattggtgttcactaacaagcacaggagctttgttatatttacagtgtcattcttggcaaaacctgaagggtgtgttcgtggggtgatgaggttcagtcacctgtgatctgtgcatctggccagcactgtggtgacatccttaggaatccatggggagagagaaagcattcaggagttagtgggtcacgtttgacaagggccaataaagaaatatgcaaagacaaaaaacaagaagaacattgtcatattttctaccttttgtttatataaatttatatcaatgattttagcttatgttaatatgcaatgtatataatatgctaacatttacaatatatgtttatagtttaaa

SEQ ID NO: 379962 - DNA, 282 bp, Homo sapiens
ccacaacttaaaataaacccatggtactgattgttggtccaagaaagcccatctgttagagactatgaagagaagagaaaattcaaatgttcccattcttgttagcatctctaaatttggaggaagatgaggttcaaactataagctaaaatgaggtttttggattattagccccacctgggtttgaatcctggctttcctgatttactagatgatagatgagtatcttttctttctttttttttcttttttttttggagacagtgtcttgctctgtcactc

SEQ ID NO: 379963 - DNA, 411 bp, Homo sapiens
ttgaaccttgtctttgacatataggtaactacacaaataagttcatatgtagctgtgcactttcatcctcttatttgttcggtttggttcatttttaataagtttacacaagcttaaatgagaatcccatgtcctttttagaattggttgcacccagcaacatttgccatcccaggaggttgggcttctcaccacacctctctagggagatgagtttgcccaaggcctagccgaaagtgtttaaagctgccaccttgctgctctggcatccataagatacttcagaggtctagctagtcctcagcatggttgacagagtcttagagataagtacatttagttcagcaaagtcctatgaaaaacacaattttaggcaggtgcagtggctcacgcctgtaaccccagcacttt

SEQ ID NO: 379964 - DNA, 544 bp, Homo sapiens
ttgaaccttgtctttgacatataggtaactacacaaataagttcatatgtagctgtgcactttcatcctcttatttgttcggtttggttcatttttaataagtttacacaagcttaaatgagaatcccatgtcctttttagaattggttgcacccagcaacatttgccatcccaggaggttgggcttctcaccacacctctctagggagatgagtttgcccaaggcctagccgaaagtgtttaaagctgccaccttgctgctctggcatccataagatacttcagaggtctagctagtcctcagcatggttgacagagtcttagagataagtacatttagttcagcaaatgctgggattgcaggagtgagccaccgtgcccagcacccactcccagtcttctagtccaaatcactggcttcaagcccttttcattgcagcccacaatgagaagcacatcttacaatcagacccagggtatgccttcccacccgcccccaccacacacacagatagttgttttgttgttgttgttgttgttgttt

SEQ ID NO: 379965 - DNA, 496 bp, Homo sapiens
cagtaatgcgttttcatttactggatgattttaaagcgtgggaactaaccaggcacggtggccatgcctggaatcccagcattttgggaggctgaggccagaggatcgcttgagcccaggagttccagaccagcctgggcaacatagtgagtcactgtctctacaaaatataaaatgaaaaataaaaattagccaacccagtcggacgcggtggctcatgcttgtaatcccagcactttgggaggccacgttaggaggatcacacgaggccaggaattcaaaaccagcctggccaacatggcaaaaccctagctctactaaaaataaaaaaataaaaaatagctgggtttggtagtaaacgtctgtaatcccaggtacttgagaggctgaggcacaagaattacttgaacctggaaggcggaggctgcagtgaaccgagatcatgccactgcattccagcctgggctacagagggagattctgtcaaagcaaaaac

SEQ ID NO: 379966 - DNA, 805 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaaggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatgtaagttcaagctttagtctaaaatt

SEQ ID NO: 379967 - DNA, 280 bp, Homo sapiens
acaatccagttaagcagtgagcacccattgtattttatttggcttttcaacacggcaatacaaacatattatgaaatgagtgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379968 - DNA, 5334 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379969 - DNA, 3256 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggta

SEQ ID NO: 379970 - DNA, 5179 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379971 - DNA, 4029 bp, Homo sapiens
agtaagcaaccgtttattctaaaaataattttgtttaaatatgtaagtttgttatagggcatggtgagttggcggcattttgtgctagcttgacttattgcttataaaattaacctcaggaattagggatttaacataaataaaatacattaaatcctaagaaaatctttcctgattccaattttgtatattctaatatgtatatatttattactttgtatgaattgtattttagtccaaatataatgcttatattatttattttaaataattaatgtttttaatcaaattaattatcacaattggctatgaggaatttcaaacctataaagtgaaatagaacttatttaaactgactagtaattctgtaacttttattttacaggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379972 - DNA, 2009 bp, Homo sapiens
cctcactcctcccctccttcgctcgctcaacctcttttgtccagtagtacaaagctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379973 - DNA, 2037 bp, Homo sapiens
  misc_feature (1964)..(1964): n is a, c, g, or t
  misc_feature (2018)..(2018): n is a, c, g, or t
  misc_feature (2023)..(2023): n is a, c, g, or t
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctacctttttgaccttgaccttggcaagaaaactnaaaaggagaaaattcaagtccagtggtgggccaaaggtaaatggttttgccaanaaaantaaaaaaatggggg

SEQ ID NO: 379974 - DNA, 251 bp, Homo sapiens
atggaatggaattcaatataaagagtttattgtggaccccatggaatgtgattaaattattagcataataaaaagacatcctatgaatttgatttcatttataagatctcttgaattgtaccccaggctaaataacagtggaaaatacagtttatatataatatgcaactcacaaactccagtgatcttgttatagtaatacttaatcattttgtaaatggtactaatcttcaatcttgctgaaaagaaat

SEQ ID NO: 379975 - DNA, 5406 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggcagtgcaatgattggagggtttgcaggaagaataggatcttctaacatgggtccagtaggatctggaataagtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379976 - DNA, 2965 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaagttggtgaggttacatacgtggagctctttaaggatgcggaaggaaaatcaaggggttgtggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggta

SEQ ID NO: 379977 - DNA, 5274 bp, Homo sapiens
cgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatggagaatgatgaatcagcaaaagaagagaaatctgacttaaaggaaaaatctacaggaagtaagaaggccaatagatttcatccttattcaaaagacaagaattcgggcactggagaaaagaagggtccaaatcgtaacagagttttcattagcaacatcccatatgacatgaaatggcaagctattaaagatctaatgagagagaaaggtgtggttgaattcaaagatgaagaatttgtaaagaaagccctagaaactatgaacaaatatgatcttagtggaagaccccttaatattaaagaggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatcttgacttcaaagttggttggaagaagctaaaggaagtgttcagcatagctggaactgtgaaagcgggcagatattaaagaagacaaagatggcaagagcagaggaatgggcactgtcacttttgagcaagcaattgaagcagttcaagcaatttctatgttcaatgggcagtttttatttgatagacctatgcatgtgaaaatggatgacaagtctgttcctcatgaagagtaccgttcacatgatggtaaaacaccacaattaccacgtggtcttggaggcattgggatgggacttggtccgggtggacagcctattagtgccagccagttgaacataggtggagtaatgggaaatttaggtccaggtggtatgggaatggatggtccaggttttggaggaatgaatagaattggaggaggaatagggtttggtggtctggaagcaatgaatagcatgggaggatttggaggagttggccgaatgggagagctgtaccgtggtgcgatgactagtagcatggagcgagattttggacgtggtgatattggaataaatcgaggctttggagattcctttggtagacttggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatctaccttttgacttgacttggcagaaactaaaagagaaattcagtcagtgtggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 379978 - DNA, 361 bp, Homo sapiens
gggggtcgtaggttgcagtgagccgagattgtaccactgcactccagcctggcgacagagtgagactctgtctcaaaaaaaaaaaaaaaaaagaatttgggttgatggggattcataggatctttttatcttggggaatcccagcatctgctctatcagctaaggcagttacatctactcataaagaaaattccttcaaaagttttgttgagtaaaaagtaaaactgtaagagttaaaagacaaagctcttttgctgtgaaacgctcagtgagctttggactgcagtcagtggaacttgtgacactggtttttctctgctgctgagataattggaaggataaaaatattgagtgccttgtt

SEQ ID NO: 379979 - DNA, 331 bp, Homo sapiens
  misc_feature (314)..(314): n is a, c, g, or t
tgattttattaacagtttatagctgccaatcactgacacaactagttacctaaaatagtcaatgctgttctcatataatgaacagttacttgcaaaaagaattaagctgatcaaagtaaatcaacaaaaatcttggtaatagaaattttatgtaaggtccaggatcacaaaagccacagaaaaatgcagagctagaacccccatatgctgcacttttattgcagggactttgactcttagggaagaggcacacatgaggggcaaggctgctgggcagacgtctccattgtccttatgttgtctgtgttgtattnttttttttttattgacc

SEQ ID NO: 379980 - DNA, 382 bp, Homo sapiens
  misc_feature (11)..(11): n is a, c, g, or t
  misc_feature (39)..(39): n is a, c, g, or t
cccaccctcangccaacaaagtaagcctgggcctacaanccccgtgtcacccacacccaagcccaactttgaaacccctgtctctcctaaaaatacaaataattagacaggcatggtgacacacgcttgtaatcccaggtactctgagactgaggcaggagaataacttgaaccaaggaggaggaggttgcagtgagccactgcacgtccttctgtctcaaaaaaaaaaaaaaaaaaaaaatgttagctttttaggtggttgggttagcagactgtgttttaatttttgatggatatgattcataacctcctatgaggatcatataaacatcttgccttgtagacctgaaatatttattgattaaaaaggggacttaggtta

SEQ ID NO: 379981 - DNA, 643 bp, Homo sapiens
atgtgtaatattttaaatattcatcccagtgtcatcccagttagtcatactctagctgtgtgattttaggcagtttacttaatctctccgtggctcagtttccttctttgtaaaatgtggattattataatacttagctcatgatgattggaaagattaaatgttatttcatataaagtgaacagaacagtacctgaaacataacagttaatagctcaataaatgttagcaattataggatcacagtccaccattcaaactcttagggtctaataggttatggaattaggaattttttttttatatgggcaaggtagtaatgtgtagccttccaatagagtccagtgcaatatcccccttcaaaagtgttactgtttctgcaacaaaatgtatgaatgttcgcactaaataggataaagactgtaaatagcttcatatcagtttgggtaaggtttaccacaagatgagttattttgggtttcagaagttttttggatttttggaattgaagataaggaacctataaaatattaattttgagtcctattttataatattaaaacatcttttcatggtattttatagttttatagtgcatggtaaattaaagtcaattaaaatgaaataatggaaaatgtccacc

SEQ ID NO: 379982 - DNA, 480 bp, Homo sapiens
gaatggataggaggctagaaaaaaaaaaaaaagccttgcttcaggcttgtgaattcctagacacaaccctacccaaagacttccttcaccaacatatttttctttctagataataggcacaaaaaccatttagaagtttgagatggaaatcatgcaatgcactctgctctttatatatgttactgaggaatctggaagcttttccgggttgaaatgcaattcctaggaaattattcttgctcttttcctgtggctgtttttaacacagcagcaatgcaatttcagtggctctgctccttcacaaagacctttgagagggaactatgctgagagatgcaaattcaaggttttctgaaaacacctcagaattgtccagttctgcccccagataaaaccactagaataaaggtcaggaaatctccagatgttcttgggacttgcgcagtcatctcaggtaattcaattagcttttgtgtctgt

SEQ ID NO: 379983 - DNA, 2474 bp, Homo sapiens
  misc_feature (969)..(969): n is a, c, g, or t
  misc_feature (1087)..(1087): n is a, c, g, or t
  misc_feature (1089)..(1089): n is a, c, g, or t
  misc_feature (1093)..(1093): n is a, c, g, or t
  misc_feature (1986)..(1987): n is a, c, g, or t
  misc_feature (2042)..(2042): n is a, c, g, or t
  misc_feature (2046)..(2046): n is a, c, g, or t
  misc_feature (2052)..(2052): n is a, c, g, or t
cccacgcgtccgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcaggtggataaaccctctgtcatcatctaagtgaggctcagctatgggggttctatcactgcagtatgcaaagagcagtagtaatatggtctcttctatctaaaaagaggatgataccccccttcatgagtagggtatgggatttgacttaaaaaaaaaaggtatatatttgaatagatccacatactttctttttttttttttttttttctgngacagtcttgctctgtcgcccaggctggagtgcagtggtgcgatctcagctcactgcaacctccgcctcctgggttcaccccattctcctgcctcagcctcccaagtagctgggactngnggcncctgctaccatgcccgactaatttttttggtatttttagtagagacggggtttcaccatgttagccaggatggtctcgatctcctgaccttgtgatccgccctcctcggcctcccagagtgctgggattacaggcatgagccaccgtgcctggccccatgtactttcttttaaatggtatacctgttatgagcgtgaagtctggcttaggattagatatctaaatttggccagtggagaagttgaccatgatcccttaagtttcattaacttgttcttcagggggtccttaaccctggctgcacattaaaatcatttgtggagcctattaaacatctaccttctttgggttcctaggtgattcattctaatgcacagtcctgcatcagaccgcttgcggagacccattgcttactgtcattcatttgaaaaatagtaattggtagggaagtattgaagaaggggagaacaatatccctaggtaataaagtttccatcttaatgcaactttttattgtactagaagtattttttttaaattcagtttgtaatacttccttttgtatagttgtctgcaaagctacctccaaaacatccagtgatttcttgccctcatccttttgggcaggatgctccttctgggcaaagtactacgccatccactttacctgcctgatgccagctcatctccttttgtatagtctttttttttttttagcatctgtcaccgtctgttgggcgcagtggctcatgcctttaatcccagcatgttgggcggctgaagtgggtgggtcacttgagcccaggagtttgagaccagcctggacaacatggtgaaaagccgtctttcaaaaacatacaaaaattaggtgggcgtggtggtacgcacttatnnttctagctactcaggaggctgagatgggaggatcaattgagcgtggaaggtcgangctncagtgngctgtgatgacaccactgtaactgtactcaagcctgggcatcagagtaagaccctgtctcaaaaaacaaacaaacaaaaaaaaaagcaatctatcactgtccttctcactatgttgtgctcctgtagcaccacctacatgtgtctctcatacttatcagatttcattgtaaatgttttgggttttctttttcctttttgcggggaaggatacataccaaactaaatagtggtgttctctgggtagtggggattgtgatggaaggcttcttgtttctacttttattatttgaatttttataatgagcatgtattattttttgcagtcaaaacaatttttaaagaaacatactataaacggtaacttaatggcaactaagtatgtcctttattttcatactctaataaatgattttctcaagtc

SEQ ID NO: 379984 - DNA, 4667 bp, Homo sapiens
gtaagtggagcaatggtcgtagtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379985 - DNA, 4475 bp, Homo sapiens
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaaggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379986 - DNA, 4849 bp, Homo sapiens
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaagggtaggtattgtttacctgctggcttggttgcactggtgaagttacatcaattctgtcagtagctgatacaaacttcagaatacccttcacctcagccacagctgcccagtcccacagcttctttcctcccaaccccagcacccctgcacccttagctccaaaattcctaaaaggttcactgtttgttcttctaatttctccccatgatgttgtgtttgaaattggtttgctctagtggttttccctgtagccttgcgtattcctgagctgcaacatcagattctggtttttctccgcagtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379987 - DNA, 1721 bp, Homo sapiens
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaaggtatcttattggcttcttgtactttagatattgaatactataattggtgggaggtggtgggaaggaggtgagatgatgggcaagtaatataaataaaaagtgactattcta

SEQ ID NO: 379988 - DNA, 874 bp, Homo sapiens
tgagacggagtctcgctttgtagcccaggccggagtgcagtggcacaatctctgctcactgcaagttccgcctcccggctggacagtgaatgtttaaggaattctcttagctaaacagggctactctattgtttaatatcagtaaaatatatattcaagaatattttaggtaaattcattgaagatcggccagtaagaggttatgaagaggaactagaggtgttggtggtatgtcttctaggctttgaattctttagctgccattctctttggattactctgccaaactattcctgtttgatggaacataccgttggcccatactggcagggcttgtgttcttattcaacattcaaaggtttctataagaaatgtgaaggcatgatgataaactcacaaaagatggatgttatttatttccattcagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379989 - DNA, 374 bp, Homo sapiens
ctaatctctaagtccgggccgcggtcggcgttctcctctggggctccgcgccccgaaccttggcttcctcatctgccctgagatgggataatccccacaggtacctttctgcgtcattaaaatgcggaaacgagaaaggcttttaccctcacccgcttcccgatgaactaatccaggcagtcggcctcatctcacttctgttgggcttttctggaagccagatggtatcgcacgtgttaaaggcgggtgcctggaagccggacgtgctgacaagacttagtttttccatctgcaagatggctgataatggttatccgtattaaccgaagcggcgataaataaaaagtttagcacagggcccggtacctcgtaaa

SEQ ID NO: 379990 - DNA, 212 bp, Homo sapiens
attaaactaaaaattttattcttttttattttttaaatctccttaagataatagaagaatttgttagtggcctggagtcttacattgaggatgaagacagtttcaggaactgccttttgtcttgtgagcgtctgcaggatgaggaagccaggtgtggagaggaggcatggaatcttgctgaaattcagtctgttttgccaacttcatggggc

SEQ ID NO: 379991 - DNA, 5191 bp, Homo sapiens
  misc_feature (5186)..(5186): n is a, c, g, or t
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggangctga

SEQ ID NO: 379992 - DNA, 4550 bp, Homo sapiens
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379993 - DNA, 4548 bp, Homo sapiens
cccacgcgtccgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagattgtaaatgccttctgccaggaaacatcacctgagatgaaggggaaggtgctcactcggttaaagcacattgtagaattgcaaataatcctggaaaagtacttggcagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379994 - DNA, 4441 bp, Homo sapiens
agtcgaaaactacgggcggcgacggcttctcggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcagtgacctactgatagagaatacttcactcactgtcccaatcctggatgtcctttcaagcctccgacttgacccaaacttcctattgaaggttcgccagttggtgatggataagttgtcgtctattagattggaggatttacctgtgataataaagttcattcttcattccgtaacagccatggatacacttgaggtaatttctgagcttcgggagaagttggatctgcagcattgtgttttgccatcacggttacaggcttcccaagtaaagttgaaaagtaaaggacgagcaagttcctcaggaaatcaagaaagcagcggtcagagctgtattattctcctctttgatgtaataaagtcagctattagatatgagaaaaccatttcagaagcctggattaaggcaattgaaaacactgcctcagtatctgaacacaaggtgtttgacctggtgatgcttttcatcatctatagcaccaatactcagacaaagaagtacattgacagggtgctaagaaataagattcgatcaggctgcattcaagaacagctgctccagagtacattctctgttcattacttagttcttaaggatatgtgttcatccattctgtcgctggctcagagtttgcttcactctctagaccagagtataatttcatttggcagtctcctatacaaatatgcatttaagttttttgacacgtactgccagcaggaagtggttggtgccttagtgacccatatctgcagtgggaatgaagctgaagttgatactgccttagatgtccttctagagttggtagtgttaaacccatctgctatgatgatgaatgctgtctttgtaaagggcattttagattatctggataacatatcccctcagcaaatacgaaaactcttctatgttctcagcacactggcatttagcaaacagaatgaagccagcagccacatccaggatgacatgcacttggtgataagaaagcagctctctagcaccgtattcaagtacaagctcattgggattattggtgctgtgaccatggctggcatcatggcggcagacagaagtgaatcacctagtttgacccaagagagagccaacctgagcgatgagcagtgcacacaggtgacctccttgttgcagttggttcattcctgcagtgagcagtctcctcaggcctctgcactttactatgatgaatttgccaacctgatccaacatgaaaagctggatccaaaagccctggaatgggttgggcataccatctgtaatgatttccaggatgccttcgtagtggactcctgtgttgttccggaaggtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaaattggtgtctccgctgtgcctggctccgtatttccggttactgagactttgtgtggagagacagcataacggaaacttggaggagattgatggtctactagattgtcctatattcctaactgacctggagcctggagagaagttggagtccatgtctgctaaagagcgttcattcatgtgttctctcatatttcttactctcaactggttccgagagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattagaccccagataaattgttgcctgcttctgtgtctctgccagcctgtgatcatttgtgttagagtttgaaatccgctgtttgcctttcttactggtaggatcctttttttgtcacctcgggtaccgagctc

SEQ ID NO: 379995 - DNA, 1902 bp, Homo sapiens
  misc_feature (1414)..(1415): n is a, c, g, or t
  misc_feature (1470)..(1470): n is a, c, g, or t
  misc_feature (1474)..(1474): n is a, c, g, or t
  misc_feature (1480)..(1480): n is a, c, g, or t
gtaagtggagcaatggtcgtagtctctcgaggccccgctcccctgcggcctaatctctaagtccgggccgcggtcggcgttctcctctggggctccgcgccccgaaccttggcttcctcatctgccctgagatgggataatccccacaggaagtaatttaagtgcacaagacattggtcaaaatggtttccaaaagaagactgtcaaaatctgaggataaagagagcctgacagaagatgcctccaaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactagctgtggatcaaatagctttccaaaagaagctctttcagaccctgaggagacacccttcctatcccaaaataatagaagaatttgttagtggcctggagtcttacattgaggatgaagacagtttcaggaactgccttttgtcttgtgagcgtctgcaggatgaggaagccagtatgggtgcatcttattctaagagtctcatcaaactgcttctggggattgacatactgcagcctgccattatcaaaaccttatttgagaagttgccagaatatttttttgaaaacaagaacagtgatgaaatcaacatacctcgactcattgtcagtcaactaaaatggcttgacagagttgtggatggcaaggacctcaccaccaagatcatgcagctgatcagtattgctccagagaacctgcagcatgacatcatcaccagcctacctgagatcctaggggattcccagcacgctgatgtggggaaagaactcaggtgattcattctaatgcacagtcctgcatcagaccgcttgcggagacccattgcttactgtcattcatttgaaaaatagtaattggtagggaagtattgaagaaggggagaacaatatccctaggtaataaagtttccatcttaatgcaactttttattgtactagaagtattttttttaaattcagtttgtaatacttccttttgtatagttgtctgcaaagctacctccaaaacatccagtgatttcttgccctcatccttttgggcaggatgctccttctgggcaaagtactacgccatccactttacctgcctgatgccagctcatctccttttgtatagtctttttttttttttagcatctgtcaccgtctgttgggcgcagtggctcatgcctttaatcccagcatgttgggcggctgaagtgggtgggtcacttgagcccaggagtttgagaccagcctggacaacatggtgaaaagccgtctttcaaaaacatacaaaaattaggtgggcgtggtggtacgcacttatnnttctagctactcaggaggctgagatgggaggatcaattgagcgtggaaggtcgangctncagtgngctgtgatgacaccactgtaactgtactcaagcctgggcatcagagtaagaccctgtctcaaaaaacaaacaaacaaaaaaaaaagcaatctatcactgtccttctcactatgttgtgctcctgtagcaccacctacatgtgtctctcatacttatcagatttcattgtaaatgttttgggttttctttttcctttttgcggggaaggatacataccaaactaaatagtggtgttctctgggtagtggggattgtgatggaaggcttcttgtttctacttttattatttgaatttttataatgagcatgtattattttttgcagtcaaaacaatttttaaagaaacatactataaacggtaacttaatggcaactaagtatgtcctttattttcatactctaataaatgattttctcaagtc

SEQ ID NO: 379996 - DNA, 803 bp, Homo sapiens
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacactgtcctggttcttcaagatcccctttgttagggagtacctcatggccaaaggtgcttctgaccatacttactggagcttctggtccatgtttctgcttggaaatgcacccttttaaattccatcccctcctccccccacccgcccccatgtcattatggcatagtagtcaaaagcatatgttctagagctaagctgcctggcattgaaccctcctagctctaccacttgtgtggtcttgagcaaactagcctcagtttcctcatccataaagtggtacagatgaaaatagtctgacatcagttgtgggatgatgactaaaagtgagatgatgcaagtaaagaattcgacactg

SEQ ID NO: 379997 - DNA, 800 bp, Homo sapiens
gcaatctcactggccttgaaaatttcatgacaagagacattaaatagggaaaccctgtttagtgcaagaaaaaatgctttatgtcaccaggatttcatcaaaatagatgagggcctggcaagcaaacaaatgttcttccagggtgggtctcatcctagcttgtgtttagaaaataaattggagttttcctacagggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttg

SEQ ID NO: 379998 - DNA, 1279 bp, Homo sapiens
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacactgtcctggttcttcaagatcccctttgttagggagtacctcatggccaaaggtgtgtgctctgtgagccagccagccatcaactatctgctgagccatggcactggcaacctcgtgggcattgtagtgggaggtgtgggtgaggccctgcaaagtgtgcccaacaccaccaccctcatcctccagaagcgcaaggggttcgtgcgcacagccctccagcatggggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttg

SEQ ID NO: 379999 - DNA, 414 bp, Homo sapiens
tgggagccttatgtcccacgttgtgcccaatccttcaccacagctagctgaagcccaaaaataccagaacacatcctctccaaattctgagctattaggaatacctccttggccatctcttgagtgatccagtaagaaagagaagaagagcagcatctgacatccagccacgggccaggcactcacagcgaggccatgtaattttcctactgaatcttcagtggagcctcccttatgccttttccacaccctggaatcaagctgccctgcacttggagttttttgcaaccatggcttcctcctggacttgttcctgtggtcccacccagaagccattcaatgcacaggaggacaatttcccgtaccccaagattgcaccctcagccagtcagcagcaagcacccattgcctagc

SEQ ID NO: 380000 - DNA, 430 bp, Homo sapiens
tttcactcaacatttctaaccaggggtcacatggcctagatgctaccctagatgagaaagagtccaatggttatcaacaagttctgaaaggcaaggcctaaggtactgaaaattatattactcaaagctgaaggcagcaaatctgttcatgtttacacagttgggaaagtggacttgtgttttttacaagcaaaccagtgaccagccaatggcaggagaccttccccacccctaaaggtgatgctcacctaccgtcatgggtaaaaggaagctctggctcgaattcctcatgtattattcatgtgtgatgccacccaacgtgattcagagaagaaaattctcagtgtgttcaccagaggtgattacatgagaataaagcacggcctgattttttttcttgttcacaggaaaaaaaaaagaaaagaatgta

SEQ ID NO: 380001 - DNA, 430 bp, Homo sapiens
acctggtggtctttctctacccaccctggtagccaaagataaatgacataatctcttgggaagactatggccctgcccatcacaggaggaacctgagtacttatccagataatcctagggcaagcttgtatcctccctataccaccgcagctgatgctgtcttgaaagcgccatcttctgactaaaccaacacaaaaccaccaaaggccaaccaacacaaaactaccgaactaaacaaaattagaaccataccctcacagagtccacttcactcccctgctactttttaaattaaactaaaaagcttatacacagtgaaagaatcaacagagtaaacagacaacctacagaatgagagaaaaactttgcgaaccatgcatctgacaaaggactaatatccagaatctacaagaaactcaaacaaatcagc

SEQ ID NO: 380002 - DNA, 302 bp, Homo sapiens
cggcttgtgtgatgtatcgttcgggaccatgataagagtggtaaatgaactggcacacggtacctgccctaatgagtccgcacccttgggagaggcaggcaggggacagtgctaaagacaaagggcaggtcctcaatgctgggacaaggggagccagctgtgaggggagaatggtatatggccaacctgtgaggtcagacccagcgtcttgggaagaggagttgaaactgagccccaggaggcggaggaggagctcaccaggctccaggttgggccgggagctccagaggcttcgccagctg

SEQ ID NO: 380003 - DNA, 1822 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380004 - DNA, 1247 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtagaacccaattttggttcaagattcagctggtctggtgggtcctttataacatgggaaatttggaggtattggaacctcttccttcaagcattttggcttggaac

SEQ ID NO: 380005 - DNA, 1352 bp, Homo sapiens
ctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380006 - DNA, 1240 bp, Homo sapiens
ctggggacccggtcgcggcggggcgggtccggagagaactcgagagtgcagagatgagggccgggtccagcgaaaaatccgacggtccagagggcgggggcaagaggcgaggggctggattgcggcccctgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380007 - DNA, 1803 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaaacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380008 - DNA, 1781 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcaggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380009 - DNA, 1670 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380010 - DNA, 1936 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtagtctcactccgtcacccaggctggagtgcagtggtgctctcagctcactgcatcctctgcctcccgggttcaagcaattctcatgcctcagcctcccgagtagctgggattataggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380011 - DNA, 1768 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380012 - DNA, 220 bp, Homo sapiens
atgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcag

SEQ ID NO: 380013 - DNA, 1707 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380014 - DNA, 1425 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtgaggactctctatctgggacactcccccaccccacctttcatttggttattcaacagacacttgctgggctttgccctcagtcatacccgagataggtcctgccttcgtggagcctccagtgcagcctgacgagagacagacccatcattagacagggacagcctagagtggtctgggctgggatcaggaaatcccaggggactggagccaccaagaagaggtgcctgactccacctgggagaatcagagagggcttcctggaggaagggatgtctgagctgagggatgaggaaagggtgacttaagagaaagaggtggaaaggagggagcagggtgtacagaggcctagaatgtgaggtaggtcacagtgagcgaccaggctggacagcttgggagaaaccagaacacaggatctctttgtgcatccactcagtacatcctttctgtctttttttgagacagagtctcactctgtcacccaacctggaatggagtgcagtggcactatcgggctcactgcagccttcacctcctgggttcaagtgatccttgtgccccagcctcccg

SEQ ID NO: 380015 - DNA, 1489 bp, Homo sapiens
ctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacaaattagctgggcgtggtggcagatgcctgtaatcctagctactcaggaggctgaggcaggaggatcacttgaacccaggagctggaagttgcagtgagctgagatcacaccactgcactccagtttggatgatagagtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380016 - DNA, 1376 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggctgagctaggagctgaagcaggcgattccttaggtgtcatatctcgtccgtcgac

SEQ ID NO: 380017 - DNA, 2280 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtagtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcggtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380018 - DNA, 1684 bp, Homo sapiens
agcggacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtcattgaccacagtggcgcccgccttggtgagtatgaggacgtgtcccgggtggagaagtacacgatctcacaagaagcctacgaccagaggcaaggtgaggtgcgggcggcgggacaatcccctcgccggggcaccgtcatgtatgtaggtctcacagatttcaagcctggctactggattggtgtccgctatgatgagccactggggaaaaatgatggcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaattcggcccgattggcccaatggaatttaaaactggaaaaagttaaacaatgggcccaaatttggggctaattggacaaattcccctaaaagggaggcgaataaaaataaatgggccgagtttaaaaaaggtggaaattggaaaaacctggggttacccaaactaaacgccttggaaaaaaaaccccttttccaaagatggggaaaaacc

SEQ ID NO: 380019 - DNA, 371 bp, Homo sapiens
tcatatgtttgttggccatttgtatctcttcttttgagaattgtctattcatgtcctcagcccactgttttgatgggattctttttttcttactgatttgtttgagttcttattagattctggatattagtcctttgtcagatgtacagattgtgaagactctctcccactctgtgggttgtctgtttactctgctgacggttccttttgccatgcaacaactccttagtttaattaggtcccagctatccatctttgtttttattgcatttgctttttggtcatgaaatccttgcctaagccaatttctagaaggatttttccaatgttatcttctagaatttttattgtttcaggttttaggtttaagt

SEQ ID NO: 380020 - DNA, 428 bp, Homo sapiens
attgatttaaaccggaaacgagtattcccaggaatcttttctgagccaagaaggctcacatctagattgttaagattcatatgaaaagcccgagcgaaggcgtcccgggggtgtgattgagctcaccttccccacgcacccgtggtgacagcagccgagtggtgtctggtgtgtggaccgaggtacaaagtgggccctgaccgagagaagggcttcttgggaattattcacctgagtcagttgtccttcaccaccttgagctggccccacttcctgtcccccccatccgtgtctgctcctggagttggaaaggaaataataagacagaggattctgggaaaggtggagggtctgttttttccttcaggctccaaaacagctcttcaggcatgtctatgttgatgccaagaagctgccagaaggaaaag

SEQ ID NO: 380021 - DNA, 211 bp, Homo sapiens
tttctacaacctaattcgctcctaaacttggctagtccccacctttggtgggggggtgtttttgcgtccccgtcctcttaggacacctaaaccaaaatgagaggcggaggaagagcaggaattaggatggcaggccttcgcctctcggtccccacttggcccagcagtcgaaacccagaaaacaaaaaaaccttcccaggtcccgacccac

SEQ ID NO: 380022 - DNA, 581 bp, Homo sapiens
tgaaggcctatgtgaaattttgcaattattttctgtattcacctaaaatggcattgcactggaaatatagtatgcttcttttgtgatttctacatatctctgtttttttctcatatcagattctactttacccctcagtgacagtcattttacacccctctctgtctcaatgtccgaggcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaa

SEQ ID NO: 380023 - DNA, 2754 bp, Homo sapiens
  misc_feature (1628)..(1628): n is a, c, g, or t
  misc_feature (1954)..(1954): n is a, c, g, or t
atttattttgatgtcggcggggtgtgcagatgaccctttcctcacgccgtctccgatattggtgttcaccaaaacatctttatccagtagtgcaaaatgtcatgctaaccttgtcttagtttcacgtctttaattctgaaacttgaaacaaaaacaatgcatcagtgggccatggagacttcttcttctgtgtatgggatactgtgtcttttattcttctattctggtatgtcctccctgatttctagtcatttttgaattatttatagacagtaaacattgcccaatatattatgaaaatgtgtttccactttattgttgcctctgaaaacattttgaacagaagcttttataagcaaggcttgaatttttcttttttatgttgtcttaggtttgtgtgagtttccacctttgtgtaacacatttttccttttaacagaaccattttatcactgtctctcttccttcttgggaaaaagaaaaccatctttttcttttcatttgcattacttacaactatgaattgatttatagagtgctaaaatatttgtaaaatcgagcagattcttctgtgtgcctttttctcctggtgatttatttaaatggatttctaaggtgttttcccgtcagtattgatttgttttggtgagtacgattttatgtgcgctatttgtctctctgtttctgaactatagcaacatttttgtgcattctctcttactctccactgaatgatgaacccttgtgaacttccaattgttttctcttcatttcttaatgtttctgagaagaccgacatattatttgtaagtgattttaaaatttgtctccttttctatgttttttcgttgtcttcagagtgtcttcagagtgcattcgtatttttgttgaattggctttgctagagaacacatgatggctttaagtatgagtgaagagagtagacattttttattcctgatttcaaggtaaaaacctaaagaggttcacctgtaaataaaataaattgtctttacaaaaccagatactcattccaagaagatctctctattctagtatacttttttttctaaacatacaatagtataggttctcatactgtgagacttcttatttctttatacacaatatatttgaaaagtcattggttttttagtgattactaatgtactgttacatggttttgaaaagtgttggattcaaagtttccttcatttaagcctcttttttctcccttccccatataaaaagttgatgatggccaggaatagaggttcacacatataatcccagcactttgggaggctgagatgggagcatcttttgagcccaggagttcaagaccagcctgggcaacatagcaaaaccccctctctacaatgaaatgaaaaattagccaggcttgttggcacatacctgctgtcccacctgcttgggaggctgaggcaggaggattgcttgaggccaggaggcggagcctgcagtgagccgtggtcacaccactgcactccagcctgggtgacagaggaagaccctgtctcaaaacaaaacaaaaatggttcctcgactttagttaggatttgaaaagcttagaactggaaggcagcctctgaaattatcaagaatgncacagcagtttgtggaacacacctgggtgggtagacccactttttagacactctctagcccaaatctgatcacagtcattcttcctcacctcttagggtctccctcacagaaggtgttgggggccttggacgagatgttgatgggatgggaataaacaggagcaaataatgtgcaggcgaagttggagttcctgctcagtctgggaggagaattgatttatgaatttctttctttctctctttgtatctatctcttctttctctctctctctctctctccccccagccaccttctgatctctaatccattcatgtgagagaagagngatgtgaaaatggtcagcaatttgctttttctgatgagatcctggtgagagtcatgttcaataaagtatttagtcacgtggggctccagtgatttctctgtttacaagctcattccttcctcattttctcagaactttggtgttaacagcctgtttcctatttgtaggggctgactttgacttagcagatgcctttcgtgatggaggaaataacgacccagcacctcttaattcacccaagctgaagccaaatgcgaaccctgagcagcctggattcattggggatgactttgacttagcagatgccttacatgacaaaggaaactacgagccagcaccactgaacccacccaaaccaaagccaaatccaaaccccaagcagcctgattccaccggggatgactttgatttcacagatgtttcttcatggtgaacgaaacagggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatac

SEQ ID NO: 380024 - DNA, 536 bp, Homo sapiens
cagtacgatagaggggagggcactgggaatttatacctcccaggaaaaataaatcatggtaaacaggcagagatctttccagattccagttcttgggggtaaaaggtccccaagatgcccagtttgtgacaacctgttttgaactattcagctcaaggtttccattttttctcccaggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatac

SEQ ID NO: 380025 - DNA, 1072 bp, Homo sapiens
aactccttaaactctccactgtggctgacttgcttattatcaccaaattattattgtttccaaaaaacgtatctcttgtgaatgataaatgaaacctgtttgcacagtggaaagttagggagtaggtgtgttgttgtttgttttggatattgttggactttgtttttgtttttaccagtatgcatagttttattttaaaactctcacagtctttggaatgatgtaaggcaaatctgactcccctggccaagttaggcttcatgagtgtgtgacttgttcgatcacccagggacccatgcttacaagggtgccatattggtttatgagtctttagttgtcatcttgaaattcttaatattcagttgagcaaggatttctgcattttcattttacacagtaccttgccaattctgtagctgatctgaaaagctgcctgataggttttattgaaaatgctttatcagtactgtagctggaagatgttggaaggatattggcaggaggctgtgtgtatgggtatccccaccatgacaaagaacaaggtccaatttttatatgtttagtgaacgtctgcatgcaaattgatgtttcattttcttcacttcaaggcactcataatctcaactctcatcttttacaaacagacgagccagcaccactgaacccacccaaaccaaagccaaatccaaaccccaagcagcctgattccaccggggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatac

SEQ ID NO: 380026 - DNA, 487 bp, Homo sapiens
gttcatttctacacccaaaccaagcagcctgatccaccgggatgactttgatttcacagatgtttcttcatggtgaacgaaacagcaccctgggaccatcctggctggaaggcatagtgacattgctggcctgagctgaagtgccgattaaaataaattgaaagctgaattaccttatgaacagctgctttacccaggaacaaatgtggagaggaactccttgaaactgtgttctcaagtagaccacttttgagaaattatacatttatcataacatctcaagtcctgctctacatagaatgaccattattatcaagaaaagttctccattccctgtaattcataaggcaatgcaggcctaaccagaaaacaggaactgcgacaaccttgcatcagacacattcgatctctctattcatagttgcattctctttttttttgtttacaaagccaatcaccaataactcggaaaacaaaaacaaaaaaa

SEQ ID NO: 380027 - DNA, 1001 bp, Homo sapiens
cccacgcgtccgctctgctcgccttgggcgcgccgtggcgcgcggggccgtgctggcgctgcggctcctcggcctgctccgccgtctggtggccgccccgggctgactttgacttagcgatgcctttcctgatggaggaaacagtgacccagcaccacctaatgcccccaaaccaaagccagatccaaaccccaaccgacctggtttcactggtgacccagcaccacctaatccccccaaaccaaagccagatccaaatcccaactgacctggtttcactgataagagcctctaaccctacggggtggtctctatgtagtgtttacctggcagtgatgtccgtgtcatctgagaagaggagatttcaggggctgactttgacttagcagatgcctttcgtgatggaggaaataacgacccagcacctcttaattcacccaagctgaagccaaatgcgaaccctgagcagcctggattcattggggatgactttgacttagcagatgccttacatgacaaaggaaactacgagccagcaccactgaacccacccaaaccaaagccaaatccaaaccccaagcagcctgattccaccggggatgactttgatttcacagatgtttcttcatggtgaacgaaacagggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatac

SEQ ID NO: 380028 - DNA, 1118 bp, Homo sapiens
aactccttaaactctccactgtggctgacttgcttattatcaccaaattattattgtttccaaaaaacgtatctcttgtgaatgataaatgaaacctgtttgcacagtggaaagttagggagtaggtgtgttgttgtttgttttggatattgttggactttgtttttgtttttaccagtatgcatagttttattttaaaactctcacagtctttggaatgatgtaaggcaaatctgactcccctggccaagttaggcttcatgagtgtgtgacttgttcgatcacccagggacccatgcttacaagggtgccatattggtttatgagtctttagttgtcatcttgaaattcttaatattcagttgagcaaggatttctgcattttcattttacacagtaccttgccaattctgtagctgatctgaaaagctgcctgataggttttattgaaaatgctttatcagtactgtagctggaagatgttggaaggatattggcaggaggctgtgtgtatgggtatccccaccatgacaaagaacaaggtccaatttttatatgtttagtgaacgtctgcatgcaaattgatgtttcattttcttcacttcaaggcactcataatctcaactctcatcttttacaaacagacgagccagcaccactgaacccacccaaaccaaagccaaatccaaaccccaagcagcctgattccaccggggatgactttgatttcacagatgtttcttcatggtgaacgaaacagggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggaagatttcagtcaagacccaagaggaggctggcatcaggctctcggtcaccgatcttcacattcaggtttcctgatgcactttgcgactctttgggcaacctctggactccttgttcccagggtccacatttagttttatctttactgcattgcttttatgaaaaagaataaaattggatgaaacagatac

SEQ ID NO: 380029 - DNA, 806 bp, Homo sapiens
cccacgcgtccgctctgctcgccttgggcgcgccgtggcgcgcggggccgtgctggcgctgcggctcctcggcctgctccgccgtctggtggccgccccgggctgactttgacttagcgatgcctttcctgatggaggaaacagtgacccagcaccacctaatgcccccaaaccaaagccagatccaaaccccaaccgacctggtttcactggtgacccagcaccacctaatccccccaaaccaaagccagatccaaatcccaactgacctggtttcactgataagagcctctaaccctacggggtggtctctatgtagtgtttacctggcagtgatgtccgtgtcatctgagaagaggagatttcaggggctgactttgacttagcagatgcctttcgtgatggaggaaataacgacccagcacctcttaattcacccaagctgaagccaaatgcgaaccctgagcagcctggattcattgacgagccagcaccactgaacccacccaaaccaaagccaaatccaaaccccaagcagcctgattccaccggggatgactttgatttcacagatgtttcttcatggtgaacgaaacagggagttgcctcgattctgatgtgtttgcttcggtgctctgtgtattgtattcatcccactcttcaattcataaactctggagattcttcaattcactgggcaaaccatatgcctaagtctatcctctgatggaggctcgtacatgcaaaatccaatagcaacctgggcgacagagcgagacttcttctcaaaaaaacaacaaacaaaa

SEQ ID NO: 380030 - DNA, 349 bp, Homo sapiens
cagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgac

SEQ ID NO: 380031 - DNA, 379 bp, Homo sapiens
tatttttttacaaaaaaccgagatgaggtctcactgtattgcccaggctgggcttgcactcctggccctcaagcaatcctccctcttgggcttcccaaagtgctgagccaccatacccagctgaattttttcatttttagtagagatggggtctccctatgttacccaggctggtcgcaaactcctgggctcaagtgattcctccgcctcgatctcccaaagtgctgagattacaaccatgagccactgcactcagcctgccccaattttttaaatgggaggaaacattggagaaagtgaactattaatacattgttaacctgtcagcccacgtttttgccactgtgcttttatttttttcctttcatattctgggctc

SEQ ID NO: 380032 - DNA, 354 bp, Homo sapiens
tttttttgagagagacaagagtcttactctgccgcccagaatggagtgcagcagcatgatctaggctcactacaacctccgcctcccgggttcaagcagttcttctgcctcagcttcctgagtagctgggactacaggcgtgcaccaccatgcccagctaatttctgtatttttagtagatatggggtttcaccatgttggctaggctggtcctgaactcctgatctcaggtgatccgcccacctcggcctcccaaagtgctgggattacagacgtgagccaccgtgcctggccaggaacacattcacatgcattatgcagtagcttaacaaaagaaaaacttcacttggggct

SEQ ID NO: 380033 - DNA, 341 bp, Homo sapiens
tttttgagatggagtttcgctcttgttgcccaagctggagtgcaatggcgtgatctcagctcaccgtaacctccgcctcccggcttcaagtgattttcctgcctcagcctcccaagttgctgggattacaggcatgcgccaccatgcctggctaattttttctactttgagacagggtttctccatgatggtcaggctggtctccaactcccgaccttaggtgttccacccacctcggcctcccaaagtgctgggattacaggtgtgagccaccgcgcccggctgagtttcataattttaaggctcttaaaaaggggagtacattagatatgcaacactcg

SEQ ID NO: 380034 - DNA, 1178 bp, Homo sapiens
  misc_feature (1099)..(1099): n is a, c, g, or t
gatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcataaanaaaataaataaaaaaaatacttaagggggggccccggtacccaattagccccttttgtgaagtcgtattaccaaattac

SEQ ID NO: 380035 - DNA, 287 bp, Homo sapiens
ggtgtgtgcctctttgtattgtagcctggagtcagtgctcgcttctgcgcctgcaggatgtccatgtgtctgctggcagcctagggcctaggcccgggccaccatggcgctgcctccaggcccagccgccctccggcacacactgctgctcctgccagcccttctgagctcaggtacacccctgttcagtcgttgaccaagtccttctgggttccaaagccccctctctcccctgtctgcacttctgtttgggtacccactccaggccccaagccctggagtccctg

SEQ ID NO: 380036 - DNA, 1982 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcataacaaaaaaaaaaaaaagacacaaaaacaaaaaaaaacgaaacaaaacaacaaaaaaaagcggggggcgcgcaaccagagagaatatccaccaggaggagggccccacacccccagacgcagcatcgccgcgagctagtgtgacaacacagcgggagcacaaaacgaggaggcgacgaacacaacaatatacagacagcgagaggcgcaacgacgggcgcccaggaagacacaaccagccagagagcacaagccaagcaggagagagaaaaaaaaacagagagacgagaaacgccgcagggaacacactccggagacacagccgcaagaagcacaccccaaacaatgcaaccacgggagggcgggggaagacaaaaaagagaggggggcacacaaccgaacacaccccaacacaaccacacaaacaaaaggcgcccccacaatagagacagcacacta

SEQ ID NO: 380037 - DNA, 1551 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccctgtaaaaaaaaaggaaggaagggagggagggaatcaaccatgccaacaaattgatcttggactactactggactactagcctccagaactatgaaataatacatttctgatgtctaa

SEQ ID NO: 380038 - DNA, 1886 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcataacaaaaaaaaaaaaaagacacaaaaacaaaaaaaaacgaaacaaaacaacaaaaaaaagcggggggcgcgcaaccagagagaatatccaccaggaggagggccccacacccccagacgcagcatcgccgcgagctagtgtgacaacacagcgggagcacaaaacgaggaggcgacgaacacaacaatatacagacagcgagaggcgcaacgacgggcgcccaggaagacacaaccagccagagagcacaagccaagcaggagagagaaaaaaaaacagagagacgagaaacgccgcagggaacacactccggagacacagccgcaagaagcacaccccaaacaatgcaaccacgggagggcgggggaagacaaaaaagagaggggggcacacaaccgaacacaccccaacacaaccacacaaacaaaaggcgcccccacaatagagacagcacacta

SEQ ID NO: 380039 - DNA, 1683 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgaggtgggcagatcgcctgagcctaggagttcgagaccagcctgggcaacatggtgaaattccatctctacaaaaaaattagccgggtgtggtgttgagtatctgtagtcccagctacttgggaggctggggtgggaggactgcttgagtccagcaggttgaggctgcagtgagctgagattgagctactgcactccagcctgggcatagagtaataccctgtaaaaaaaaaggaaggaagggagggagggaatcaaccatgccaacaaattgatcttggactactactggactactagcctccagaactatgaaataatacatttctgatgtctaa

SEQ ID NO: 380040 - DNA, 1850 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcataacaaaaaaaaaaaaaagacacaaaaacaaaaaaaaacgaaacaaaacaacaaaaaaaagcggggggcgcgcaaccagagagaatatccaccaggaggagggccccacacccccagacgcagcatcgccgcgagctagtgtgacaacacagcgggagcacaaaacgaggaggcgacgaacacaacaatatacagacagcgagaggcgcaacgacgggcgcccaggaagacacaaccagccagagagcacaagccaagcaggagagagaaaaaaaaacagagagacgagaaacgccgcagggaacacactccggagacacagccgcaagaagcacaccccaaacaatgcaaccacgggagggcgggggaagacaaaaaagagaggggggcacacaaccgaacacaccccaacacaaccacacaaacaaaaggcgcccccacaatagagacagcacacta

SEQ ID NO: 380041 - DNA, 1552 bp, Homo sapiens
cggccgcccacctgccgggtaagggcccctcgggcccgtggtcgggcatcgattggccccgcctggcgcagcccccgcccctgcagcggactgcggtgctcatcagacctgagcagttgctccggcggcgctcggggagggagccagcagcctagggcctaggcccgggccaccatggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaattcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccagggcttctggctacccgggtggaagtgccactgctgggcattgttgtggctgctgggcttgcactgggcaccctcgtggggttcagcaccttggtggcctgcctggtctgcagaaaagagaagaaaaccaaaggcccctcccggcacccatctctgatatcaagtgactccaacaacctaaaactcaacaacgtgcgcctgccacgggagaacatgtccctcccatccaaccttcagctcaatgacctcactccagattccagagcagtgaaaccagcagaccggcagatggctcagaacaacagccggccagagcttctggacccggagcccggcggcctcctcaccagccaaggaagaagaaatcaggacaaagacgcataacagagggaagaccatgggaagacacagaagatggccaagaagagacccctcagaagaaatcaatcttggtggggcgtggtggcttcacgcctgtaataccagcactgtgggaggttgagagaagagtctcctattgttgcccagaccggtcctgaactcctggcctcaagtgatcgtcccacctcagcctcccaaagtgctgggatttacaggtatgagctaccgtgcctggcccagtttcctttccttattgatatataagagctctttgcttggacagtaattttttctattacatacatatataaaatattttttctca

SEQ ID NO: 380042 - DNA, 336 bp, Homo sapiens
gttgtcttaactggttgtgataattttatgtgtcagtttaactaggcaaacggtacctagataactggtgaaacaaaatttctgtgaaacatctgtgaagatgtttctaaaagagattagcatttgcatcagtagacggggtaaagatgaccctgaccaatgtgagtaggcatcatccaatctgttgagggcctgaataaaacaaaaaggcagaggaagtgaatttgctctctctgctttagcttggcatatccaatttttccgggcttctgacattggcactcctggttctcagaccttcaaacttgaactgggatttataccatcagccttcca

SEQ ID NO: 380043 - DNA, 476 bp, Homo sapiens
tgcagtgttctagtgaaaacactagaatagtgttgagtatataattgaggtttgataggtattttctaactaaataaatgaatgcgtgaacctgactgtcccattatatcttattaacaataccttgaaacaacttagaatgactatttgcttccaatgtttggaaggaatgaaacacaaatttgaatatggcagtggtatgttattatctaagtgaaccttaattataaccaaaacatggtttcaggtgctacttcgataagtttctgcccccacctcccactcccgtataatatatgtactttaacaattagccaagactattcactaagcaaagaacattactgagcaaacagcatcagagaccatactaaataaacaaaccaccaaatggactgctctataatgagattaagctttgcacagttccaaaaaaattgaagttctagtataatactttgtatcaaccctataaa

SEQ ID NO: 380044 - DNA, 392 bp, Homo sapiens
tttagagacagggttttgccatgttgccaaggctggtctccaacttctgagttcaggcagtgctcccatctcagcctcccaaagtgctgagattataggcatgagccaccacgcccagcccacattaagacttcttatatccattttagtctctgctctttgtccttaatttttaagggttgtgttaaaatgcaaggtaaacacaaatgctgaaataagtgatgagcaagtaccctaaagttaggaggcagagattactgaactgtgtggcagttgttattgtcactgctttgaaaaccttaatcttaaagatactttaccaaactagatgggtcctgtaagtgaacacacgctccaaagtgcactgcggcccgacagcattcttttccgtg

SEQ ID NO: 380045 - DNA, 451 bp, Homo sapiens
agactttggacttttcagttaatgctggaaggagttaagactttgggggactgttgggaaggcatgattgtgtcttgacatgtgagaataatatgagatttgggagaggctggggagaatgatatggtttggctctgtacccccatccaaatctcatgttgaattgtaattcccagtgttgggaggggacctggtaggaggtgattggatcatgggagcaaatttccccttgctgctctcgtgatagtgagttctcacaagatctgatggtttaaaagtgtgtggcacattccccttcacatgctgtttctcctgtcactatgtgaagatgtgcttgcttcccctttgccttctaccatgactgtaagattcctgaggcctcccccgccatgcttcctgtacagcctgcagaactgagtcaattaaacattgcttctttataaactaccca

SEQ ID NO: 380046 - DNA, 447 bp, Homo sapiens
ctgaaccaaatttctacttctgctctctgtttttctaaaaaacactaaataaaagactatgcttgcttgaatctcctttaaaaccatgatgaattgtgggaaatggttagctgacctgctctagcaagacagaaacctcaacaaaacaccccaaaccacacaaaaaaaaacaaaaccctcacagagaaaaaaaaaaagaaaaaaaaaatttgggaggccgaggcgggtggatcacgaggtcaggagatcgagaccatcctggctaacacggtgaaaccccgtctctactaaaaaatacgaaaaattatccgggctaattttgtattttgtaaaaatacaaaaaattaggtggcgggcacctgtagtcccagctactggggaggctgaggcaggagaatggcgtatcccgggaggcggagcttgcagtgagccgagatcgcgccactg

SEQ ID NO: 380047 - DNA, 169 bp, Homo sapiens
gcccaggctggagtgaagtggtgcgctgttagctcgctgcaacctccgctcccgggttcaagcaattctcctgcctcagcttccctagtagctgggattacagtgacagatgaagaaacattccaggttgctgtttgcagaacttctgtgcaagtaaggagttattaca

SEQ ID NO: 380048 - DNA, 455 bp, Homo sapiens
cagcatagctactaaggaaagactgatatctttaaagaccttaggcaagtaatctttggggatgcagaaaaaaaaccctgagaagagactctcataacaccactaagctaaaatcctaggagagtaaacatcctttctctgtcccaggcagctgataaagtcactttgcactggacccttagtcagcaaaagctacagaaccacagggtcattatttttggaacagaaacagaatagattctggaaagttcctgtgatcaatgtgagaataatgaggcctctccccaccatcaccccacctctgctttggtcctgagctccagcccagggtgtgacagctgtggccagctgaggtctgaagtgggcggctctgcagcctgtagggtgggatggaggtggggccaggaggagcaggaatgagtattccagcacaagttctgccagtgtcctggggg

SEQ ID NO: 380049 - DNA, 392 bp, Homo sapiens
tccaatcagctgagctgctgccatggagattttctacaataaaaagcagaaactgtcaccttcctgtttagaacccttcattcgttcagaagtttaaaccctgtattttagaatacagaacacaattttagcatctgccttctactcacttcccccacagataccattcagcctatctgggctctcccggcagtttctcacatgttgtgcgtgagcatcacagggctccggggaccctagctgacaatgttccccccatgacacttgagtgtcctgcatttgctttcctagctcctcttctggatccatcaccgagagcactcattcacactccacagtaattgttggtttacttctcagattatcaagatgggactgtagattaagctctg

SEQ ID NO: 380050 - DNA, 216 bp, Homo sapiens
cctgaacttaaaagttaaataaaattacagggggaaatttctttttagcaatattaagtcttctgacttaagcaagaaaaaaaagtgagtgttgctgggattacaggtgtgagctactgcacctggcccgataggcaagtctgacacaaagaatgattccctaaaatcttatccaatgcagtaataattcctcctaacgctaccctcagcaacact

SEQ ID NO: 380051 - DNA, 1004 bp, Homo sapiens
agctgtgtggcatttttcaccctgccgggttcccttgccagacatgatgtcggttatctggcaaaagccattttatgtcggccacgaggcaggtgttcactgtgcatcattcattcaccccatgatgttctggaagtaaaccttggttgtctttcgttggccagaggaattgggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgtacagggactcatgcctttaattccagtgttttgggagactaaggcaagaacatcctggaggccaggagttcgacactgtataacagatatatctgacagcagtaactcaagcacaccctaagaatgaccctgtggtctaagaagagtgttggttcagcgttccaaacgaagaaatccaggagtggccaacctggaggtttctgaacccctggcctgttccttggaatgaggccctttgttttgagctaggcggagggtgataagtgaaaatactatataaactgcatgcttctttcaaatgatagtggtttttttgtccagcctgccgctcctggactgccctgtatctaagtcctcaataaaccctatgtctcattttctttctttctttcttttttgagatggagtttcgctcctgttgcccaggctggagtgcagtggcgtgatctcggctcactgcaacc

SEQ ID NO: 380052 - DNA, 1218 bp, Homo sapiens
ggcatcatctggctgcaaagaagagaacacactgtgtttgagggaggaggaaggaggatcagagtttaaactcctgccataatgcagcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcagaatgtccgtctgtctgcccaggctggagtggcacgatctcagctcactgcagcctccacctccagggttcaagcgattctcctgcctcagcctcccggggatctcaagggcatttccctttgcccacctcaccttttcatatttggtaaactgtatgcatttgcctccagcccaagattataaatatgaactgattatgatctgcatgttctctctttgggttcaagcatttccttacagaagagccaccgtggaagtcatgggtaaatatgtgttgaattggtaactccctcttggagaatttcttgtgaattacacagcaataggggaactcatttaactggagacataatctcaatttgtaaagtgtggcccattttctaacatttttattttgcataccctcccctctcttctcgattgatgaaactaacaaagaggttaataaaagcccatctcgtcatgtacagggactcatgcctttaattccagtgttttgggagactaaggcaagaacatcctggaggccaggagttcgacactgtataacagatatatctgacagcagtaactcaagcacaccctaagaatgaccctgtggtctaagaagagtgttggttcagcgttccaaacgaagaaatccaggagtggccaacctggaggtttctgaacccctggcctgttccttggaatgaggccctttgttttgagctaggcggagggtgataagtgaaaatactatataaactgcatgcttctttcaaatgatagtggtttttttgtccagcctgccgctcctggactgccctgtatctaagtcctcaataaaccctatgtctcattttctttctttctttcttttttgagatggagtttcgctcctgttgcccaggctggagtgcagtggcgtgatctcggctcactgcaacc

SEQ ID NO: 380053 - DNA, 209 bp, Homo sapiens
gaacttttcccaggaggagtggagtctccttagtgaggttcagagatgcctttaccatgacgtgatgctggagaactgggtacttatatcctccctgggtaagttcctcacaccctaccctatttcctgaatagatctctgcccttccccttttctcccattggcaagactgtcttttatcatgtcaggaccatgggcacagcttcctt

SEQ ID NO: 380054 - DNA, 911 bp, Homo sapiens
ggcatcatctggctgcaaagaagagaacacactgtgtttgagggaggaggaaggaggatcagagtttaaactcctgccataatgcagcagggcactgtggcatttgaagatgtggctgtgaacttttcccaggaggagtggagtctccttagtgaggttcagagatgcctttaccatgacgtgatgctggagaactgggtacttatatcctccctgggttgttggtgtggatcagaagatgaggaggcaccttctaagaagagcatttctatacaaagagtgtctcaggtcagcactcctggggcaggtgtgtctcccaagaaggctcactcttgtgaaatgtgtggcgcgatcttgggagacattttgcacttggcagatcatcaggggacacatcacaagcagaaactgcacaggtgtgaggcatgggggaataaattgtatgatagttcaaaccgtccgcaccagaatcagtaccttggagagaaaccctatagaagcagtgttgaggaagcattgtttgtgaagaggtgtaagttccatgtgtcagaggagtcatctatcttcattcagagtggaaaggactttttgcccagctcaggattactgctgcaggaggccactcacactggggagaagtcaaacagcaaacctgagtgtgagtctccctttcagtggggagatactcattacagctgtggagaatgcatgaaacattctagcaccaaacacgtatttgttcaacagcagagacttccctctagagaggaatgttattgctgggaatgtgggaaatcctttagcaaatatgatagcgtcagtaatcatcagagagttcacactgggaaaagaccttatgaatgtggagaatgtgggaaatcttttagtcataagggcagccttgttcagca

SEQ ID NO: 380055 - DNA, 923 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggtgggaccgccgacggcaaaggctgcctcccggggctgcgctgcccttcaggag

SEQ ID NO: 380056 - DNA, 3945 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380057 - DNA, 3968 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacaggcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380058 - DNA, 4170 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggtgagtgaaagagcgacggtcagggataagccaggcatttggatatgtgggtgggaactgtcacaacaggagtgagaagtctctctttcctgctccaggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380059 - DNA, 1205 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtatctgcacttctcctgagtgg

SEQ ID NO: 380060 - DNA, 377 bp, Homo sapiens
gctctgttgggtgtctctggtgctgctcctcccacactcacgtcacgttcttacaggcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaaggtaccagtgtctccctggggccaaaacggccttatcttgaccctgttgtgtagaggcctttgcagccagcaggtggcagtgtgtgtgtgcactgcaggttccatctgggggcacctaccagttctcttcaaaggagtttctctctctttag

SEQ ID NO: 380061 - DNA, 240 bp, Homo sapiens
cttgggtgagagtcctgcagctctggctggctctctgacgtgctttccatccttcccacctcccaggacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgt

SEQ ID NO: 380062 - DNA, 288 bp, Homo sapiens
cctttgctgccttaggttaagtgtctgagcatggttgggggttgcggggaaaagggaccattcctctagcacagagagggtagcagaatagagggcgtcctgccaaggggccgcctgggctggatctcacttgctgccctctgtcacaggagaaggtgcggcttcggtataagctgaccttcgccctgggggagcagctgagcacagaggtgggcgaggtggaccagttccctcctgtggaacagtgggggaacctatgaccccagaggacgctgtgatctccacctt

SEQ ID NO: 380063 - DNA, 3973 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacgtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380064 - DNA, 4072 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380065 - DNA, 4363 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggagctgtttgatcagtgtgagaacaagaggcggactttatttaaactcgccagtgagactgaggacaatgataacagtttgggggacatcctgcaagccagtgacaacctctcccgggtcatcaactcttacaaaacaattattgaagggcaggtcatcaatggcgaggtggctaccttaaccctgcctgactcggaaggaaacagtcagtgcagtaaccaaggcacgctcatcgaccttgcggagctggacacgaccaacagtttgtcctccgtgttggccccagcacctactccaccctcctcaggcatcccaatcctccctccaccaccccaggcctcaggacctccacggagccgctcctctagccaggccgaggccaccctggggcccagcagcacaagcaacgccctctcctggctggacgaggagctactctgcttgggcctcgccgacccagcccctaatgttcctcccaaagagtcagctgggaacagccagtggcacctgctccagagggaacagtccgacctggacttcttcagccccaggccggggaccgctgcctgtggcgcctccgatgctcctctgctccagccctcagccccctcctcaagcagctcccaagctccactgccgcctcccttcccagctcctgtggtcccagccagtgttcctgcccccagtgcgggctcctccttgttttctactggagtggccccagccttggccccaaaagttgagcccgcagtccctgggcaccatggcttggcgttgggcaacagcgcgctgcaccacctggatgccctcgatcagcttctagaagaggccaaagtgacctcgggcttggtgaaacccactacctcccctctcatccccaccaccaccccagccaggcccctcctgcccttctccacggggcccggcagcccgctcttccagccactgagtttccagtcccagggcagccccccgaaggggcctgagctctccctggccagcatccacgtgcccctggaatcgatcaagcctagtaggtgttggaggattgaggtgggtggggcggtggggcctatagccacggagctgtaggacatgcgacagggatggatccaggcactctttgcagggggtcccttaaagccaggcaggcctccctgcctgcattctcagtcttaagctcctcactgagcgcctctcccagattccgttaggaagcactggactcatcatgaccacggagtagcccttttctcctcaccgccggggctctgttgggtgtctctggtgctgctcctcccacactcacgtcacgttcttacaggcagtgcccttcctgtgacagcctacgataaaaacggcttccgcatcctcttccactttgccaaggagtgtcccccaggacgacctgacgtgctggtggtggtggtgtccatgctgaacacggctcccttacctgtcaagagcatcgtgctgcaggctgcagtgcccaagtcaatgaaagtgaagttgcagccaccttctgggacagaactctctccatttagccccatccagccacctgcagccatcacccaggtcatgttgctggccaatccactgaaggagaaggtgcggcttcggtataagctgaccttcgccctgggggagcagctgagcacagaggtgggcgaggtggaccagttccctcctgtggaacagtgggggaacctatgaccccagaggacgctgtgatctccaccttgaagccaggcaggctgccctgagacgaggagggctctggtcccgtcactctccatgccctgacaacagtgcttgtagctttgatgtggaacaggggccctgggcatttctgctgagaaccaaactgctgctgtgataacctctcctttggcccctaaaaggacctgtttttatctacctgtgtgacttgaagtggccatatgctgtcaggggtgcggagtggcccctgacttcactgctgtcccgggaacatggacccccaggcttggcgtaggtgtttgcttccttctactggcattcactgaagccactggggtggggggtggggggtgggagtctctaaagagagactgtcatgggtcattccccacaagagccacatcctcacacctgacagatgcacggcccaaggggctgcagccctgttgcaattccatgcttcccccgccaaccagctcctgctgccatccccagggaggtggcccaggaaggtgcctggcccagaataaggaactggcatactgcaaagtccccagccctgcctctggtggacagcatcgtcctggaatggccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380066 - DNA, 1263 bp, Homo sapiens
ctgtcaagaagtgccctggcagtttcaatgcggatgaggacgatcgggtggacatctgggcccccagccggagtcgcaccagcaactctctgccagctcccacaccgactacgcttccatccccaggtagctggggcagcctctgccaggcttgggtgtgcctggcctgggactgaggctgcccacggagtgatgagttgtgtgcttgtccctggcagtggcaggctgtgtcctatggacatcttggcaggacatggaatttggcctcatgacaggcccaactagggataggaaggaaaatgaagagagccagtatttccccttctccagaagcaggtactcagctttctgggaaaagcgtgcctccagccgtggggacaggccatcctactgactacctcttgcttggcatgaaataaactgctatcctccccttggaatctaccgccactctacatcctactgctttggcctccctctcctctcaccagatggcatgtggtgtggcacctgtggctggacacaggaggcctcaggatcacaaatgttacactagacatatgtcctaatgtgctgcccagaaacctcaactgttccccagctactgaggggcactgtcagcgagatgttgggtctggaggtgatgagatcgggccacacttgagctgagtcaccagaccctattgcttcaacagtgcttggcccccgccagcttgtcccagccactctagctgctggatgtgatcctgggacatgtactccaagcctccgtcacaaaaaaaaaatcaccagctgccatagacacgggggaagcttgcggagcccaggtgaacaagctcagcaatcggacatctctggggaaaggaaggtggcacagaccatgttccctggttcctccctgccccttgccaggcttccttattccttactatgggaagaggtcatatcccttccctgcccctcgctgtctttagcaagcaggtttcactgcttcattagaagaggacaagtcaaaagtgaatcatttttcactacttaaggaataaatccaagagctttccagagactggctgctgcagccctgggaatgtctgtggaattactatgtggaaatggaactttgtgttatgctctagacattacagttatttgagtgttactcgttactgttgaggtcagtgcttcgtggcaaatggctgtactggatatcccagctctgctgcccttgttttgctgcatgttaaataaaaccattttcactgt

SEQ ID NO: 380067 - DNA, 1022 bp, Homo sapiens
atctgcgtttctctccactgatctggacgttagagtttttcactccggggtccaaaggggagcgccaaaaggaaacccttgccctccctgtatccgtcgcagtctggcgcggccctcggtgacggcactcactcctctcaggaccccatgcaggccccgccccgtctcagctcgtgcagactctcgcgagttttgaagccgcggggccgggcggctgcaatatggcggaggcggaaggggaaagcctggagtcctggctcaataaagccaccaatccttccaaccgccaggaggactgggaatacataattggcttctgtgatcagatcaacaaggagctggaagggccacagatcgccgtccgactgctggcccacaagatccagtccccacaggaatgggaggcgctccaggccctgacggtgctggaggcatgcatgaagaactgtgggaggagatttcataacgaagtggggaagttccgctttttgaatgagttaatcaaagtcgtctctccaaagtacctgggggacagggtgtctgagaaagtgaagaccaaggttattgagctgctgtacagctggaccatggccctgccagaagaagcaaagatcaaagacgcctaccacatgctgaagagacagggcatagtgcagtctgacccaccaattcctgtggataggacgctgatcccctctccaccacctcgtcccaaaaaccctgtttttgatgatgaggagaagtccaagcttttagccaagctgctgaaaagcaaaaacccagatgacctgcaggaggccaacaagctcatcaagtccatggtgaaggaagacgaggcacggatccagaaggtgaccaagcgtctgcacacgttagaggaagttaacaacaacgtgagactgctcagtgagatgctgcttcattacagccaggaggactcttcggacggggacagagagctgatgaaggtgggaccgccgacggcaaaggctgcctcccggggctgcgctgcccttcaggag

SEQ ID NO: 380068 - DNA, 394 bp, Homo sapiens
ctaagttaccccagttacctccaagtttcctgaaaaggggcagtgtttgggataagcaggttaaatatctgtttcattttctccaagttctaccctgtgatcacatatgaaatcacccagaagttagttttcaggcatagaccaggaggagaaagagtcttcaaactaaaagttagaaaatgctatgctttgtattttattaaacattgtgtgaacgacacacatcgtttggttacctgatctttttttacaccagactaggaaatacttttttgagaggtgatgacagtggtcatcaatggtttagcatcaatctgcttgactggattatgttgattgtattattggccatcacctggcaaggcacaattatagctgagatagatctggaagt

SEQ ID NO: 380069 - DNA, 1751 bp, Homo sapiens
gttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcggtgcgtggcactaggctgggtgtggtgggtgctgccgaaaaaagggttcctcccatccatttgcacgtcacccttcccacctcctgcccagatggacagaagtgaggacattcatcggccgcattttactaatggcaaggagatagcgactgaagggcaagaacctagggtttcctgtctttgatatttctcatctttgaggtaagtacacctggacagtcccttccttcctcctcagggctcatgctttcttgcctatccgtgtaattaatatgatctggctatctttgtctttgttccgaaacttcagctgcaaatgaaagtgtaagttaggtctgagtctgcactatagacctagctatcctaggttaaaggggataaaataggaatcaagaagcctggcccgcttgggctcccagctcaagtgcattctgcaatccagtttatattaggcctccatgtgggtggctatcctttatcaagatcccccccagggagaggaggattattagtcacattatcaaactcccctccaacccctttctctgcttagaggtatgtgtaatgtgtagtagaaagaccgaatccccacccaaaagtccttactgctactcatgtttttaaccttctgttctttaccctactccctaataatgaccgccatcatttatctactgcttaatggatactaggcactgtgctaagggttttatgttttacttcaatcttttcatcggctttattttgatagtttgttttatagaggaggaaacagacttaggtaagttacaagatgacaaggttactaccttgttcagttagtagtcagcagctagtatatccaaagatagtacgagtcagaactaggattataaactcagggctacctgaaactcacaacttcaggcatctttgatttcttcttttcacccacagccaattcttcaactaaattgtatccattctgttttcaccgtctcttgtactggtctcctttctattgtaactgtcatcatcctaactcaagatccttctgtagctttccccggttattggaatatccttattacgactgccaccttttctaatccagtctgtttactactgccgggttaatttccccaaactgcatgtctggggaataaccttgtggttatgacagaattcccaaaggaaagcaaacttggcaaggtgcaaagactatgaagacttagaacttaagagttctatggagatcttcagaaatataaattagctactcaacatatctgttattctgccctgattgcactgtaaagcaaaaggagagaggccattatggggaaaaagatccaaaaggactcatctaaaacacaagttgggtagaggagataggtgagtactattatattatgttcatggaaaatgagttcatgggctttcctctaatttttattttaaaaataaatgtaaatattaaataaaattttttaaatgaaaaaaaaaaaa

SEQ ID NO: 380070 - DNA, 563 bp, Homo sapiens
gttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcgatggacagaagtgaggacattcatcggccgcattttactaatggcaaggagatagcgactgaagggcaagaacctagggtttcctgtctttgatatttctcatctttgagcaaaaggagagaggccattatggggaaaaagatccaaaaggactcatctaaaacacaagttgggtagaggagataggtgagtactattatattatgttcatggaaaatgagttcatgggctttcctctaatttttattttaaaaataaatgtaaatattaaataaaattttttaaatgaaaaaaaaaaaa

SEQ ID NO: 380071 - DNA, 1698 bp, Homo sapiens
gttgcagcttcaccctcgcagattcggcttagcgagcgagtcggtgcttccgcggatcaaaattattagccgttttattagagcccattaaacgttgcataaacatggttcagagctgcctgggagaagaaaagccaaaggatgccaccctctcgatttatcccaccctcgggagtctgaaagccgacgccaggagaaatcccgcgaaggccgcccgggatcctggtagaggcgacgctgtgtgcgtttatggagcgcttgcggtgcgtggcactaggctgggtgtggtgggtgctgccgaatggacagaagtgaggacattcatcggccgcattttactaatggcaaggagatagcgactgaagggcaagaacctagggtttcctgtctttgatatttctcatctttgaggtaagtacacctggacagtcccttccttcctcctcagggctcatgctttcttgcctatccgtgtaattaatatgatctggctatctttgtctttgttccgaaacttcagctgcaaatgaaagtgtaagttaggtctgagtctgcactatagacctagctatcctaggttaaaggggataaaataggaatcaagaagcctggcccgcttgggctcccagctcaagtgcattctgcaatccagtttatattaggcctccatgtgggtggctatcctttatcaagatcccccccagggagaggaggattattagtcacattatcaaactcccctccaacccctttctctgcttagaggtatgtgtaatgtgtagtagaaagaccgaatccccacccaaaagtccttactgctactcatgtttttaaccttctgttctttaccctactccctaataatgaccgccatcatttatctactgcttaatggatactaggcactgtgctaagggttttatgttttacttcaatcttttcatcggctttattttgatagtttgttttatagaggaggaaacagacttaggtaagttacaagatgacaaggttactaccttgttcagttagtagtcagcagctagtatatccaaagatagtacgagtcagaactaggattataaactcagggctacctgaaactcacaacttcaggcatctttgatttcttcttttcacccacagccaattcttcaactaaattgtatccattctgttttcaccgtctcttgtactggtctcctttctattgtaactgtcatcatcctaactcaagatccttctgtagctttccccggttattggaatatccttattacgactgccaccttttctaatccagtctgtttactactgccgggttaatttccccaaactgcatgtctggggaataaccttgtggttatgacagaattcccaaaggaaagcaaacttggcaaggtgcaaagactatgaagacttagaacttaagagttctatggagatcttcagaaatataaattagctactcaacatatctgttattctgccctgattgcactgtaaagcaaaaggagagaggccattatggggaaaaagatccaaaaggactcatctaaaacacaagttgggtagaggagataggtgagtactattatattatgttcatggaaaatgagttcatgggctttcctctaatttttattttaaaaataaatgtaaatattaaataaaattttttaaatgaaaaaaaaaaaa

SEQ ID NO: 380072 - DNA, 346 bp, Homo sapiens
attcaggacctattagagaagttccctggctctttaaaactgctttatttctgaaatcaaggggaagcaactcatgatcatacagtgaatgtacttttttggcttcaaaggtaaaaatagctcttaatggttcttaagctcactaaaaattcaggctgaacatatacctcttgagtcatctcctcaaagactaaaaggggcaagaaatggaaagagaacaaggcaccaataggaaaaaagctctaaactgtttacttggttgagatcagatttccttatctcagatttcctcataaatttagttactcaagagtaattgcggctcttcatccagattgcaaatatg

SEQ ID NO: 380073 - DNA, 345 bp, Homo sapiens
gtcagttgttgggttatgtattttgcatttgatatttaatttaatctttgtaatagccagagacttggatcttattggcatcattttccagatgagcagagctaataaatggcagaactagaattcaaatctgaggctctctggcattgaaaacaacaacaaaacatgtttctactcttcaaagagactttttctcctggattgtcacttgtccttttctttctctttctctcctgacattggtatttaaaatgagaacctaggaaacttgtttcttctaacctaatgtttttgaagcagttttaggtccttggagatgtgccttgatgtgtctatacaatatag

SEQ ID NO: 380074 - DNA, 311 bp, Homo sapiens
gaagccactttaatccacaaggaacttatcactgaataaaccaaattaagatggacacacattgaacataatacaaggcagccattgggctcagaagagggggctcaggaatgtctacaataaggaggtgaagtttgagatggactttgaagaacccataaaaagtgaagtggccaggtgcagtggctcaagcctgtaatcccagcactttgggaggccgaggcgggtggatcatctgaggtcaggagttcaagaccagcctggccaacatgggaaaaccccgtctctactaaaaatacaaaatttagcct

SEQ ID NO: 380075 - DNA, 2623 bp, Homo sapiens
gaattccgcagagggagggaaggaaaccgccagttaaccacatggtagctgaggggctgctcagcaggattcattttacgcttcttctgaatcgctgtgtattcctcattagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatcttt

SEQ ID NO: 380076 - DNA, 3037 bp, Homo sapiens
  misc_feature (2980)..(2980): n is a, c, g, or t
tgccgtgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaaactgtgatcttctttggagattttataagccagtgatcctcaattaagggatccacccttcagggatgaggaaccatattgggttcttggggggaatctgtngggagtgtattgtttgaaaaagcgtatttttgtgtgtgtgtatgttggagatacaaa

SEQ ID NO: 380077 - DNA, 2873 bp, Homo sapiens
  misc_feature (2816)..(2816): n is a, c, g, or t
tgccgtgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatctttaaaactgtgatcttctttggagattttataagccagtgatcctcaattaagggatccacccttcagggatgaggaaccatattgggttcttggggggaatctgtngggagtgtattgtttgaaaaagcgtatttttgtgtgtgtgtatgttggagatacaaa

SEQ ID NO: 380078 - DNA, 429 bp, Homo sapiens
ttaccatgttcatgaacacaaaaatagttgataaggaggcaatggtgacaaaaagaaagctggaatctgcctttcaataagcaagaaatagtcctctcatccaggtcatgtcgtccacattccattggcaggtattgtcatatctgcatcctacattgtgaggtcaccaaggcaacctattaatcattctagaatctacctgccgtgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggtaagagaagagcacttagtggaccaggtgaatggagtatgatccgggtaggcat

SEQ ID NO: 380079 - DNA, 2875 bp, Homo sapiens
tgccgtgaagattacaaatgagactgggaaaccctcttcaataagacctgtgtgatgatagattgtgtcctgagcccgcaggtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctgaagcttgaattttgcaaacacacaagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacagattattgatattctgtggagtgatcccagaggcaaaaatggctgttttccaaatacgtgccgaggagggggctgctattttggaccagatgttacttccaagattcttaataaataccagttgaagatgctcatcaggtctcatgaatgtaagcccgaagggtatgaaatctgtcatgatgggaaggtggtgactatattttctgcttctaattattatgaagaaggcagcaatcgaggagcttacatcaaactatgttctggtacaactcctcgatttttccagtaccaagtaactaaagcaacgtgctttcagcctcttcgccaaagagtggatactatggaaaacagcgccatcaagatattaagagagagagtgatttcacgaaaaagtgaccttactcgtgctttccaacttcaagaccacagaaaatcaggaaaactttctgtgagccagtgggctttttgcatggagaacattttggggctgaacttaccatggagatccctcagttcgaatctggtaaacatagaccaaaatggaaacgttgaatacatgtccagcttccagaatatccgcattgaaaaacctgtacaagaggctcattctactctagttgaaactctgtacagatacagatctgacctggaaatcatatttaatgccattgacactgatcactcaggcctgatctccgtggaagaatttcgtgccatgtggaaactttttagttctcactacaatgttcacattgatgattcccaagtcaataagcttgccaacataatggacttgaacaaagatggaagcattgactttaatgagtttttaaaggctttctatgtagtgcatagatatgaagacttgatgaaacctgatgtcaccaaccttggctaaacacaaatgagagcttccctcaggctccctgaaacagctaggcccaaatcacaagtacagtcctttccaacacccctgaaattcatagtcagtagcagagaaaagcagatcccaattcatcccacaaacagatgcatagtatgggttttggaagtccctagcaagctgttattggtaagattaggttaaatgtcagtaataggatttggtttcagcattagtacctacatattgccagtgagaaactgggttggacctagtggtgttgtcgtgagtgccacctaaccaggaggccagagcggtttgaaaacatcctgaaaggaactcatacagcacaagagaaaactactaagcttgacatctgtgagtgactgagggagacaggaggaataccaggttattcatggaataaagtctttccatcttt

SEQ ID NO: 380080 - DNA, 945 bp, Homo sapiens
  misc_feature (923)..(923): n is a, c, g, or t
ggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcagaagaaacagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatcactgagagctgcgttgatcatccagaactggtaccgaggttacaaagctcgactgaaggccagacaacactatgccctcaccatcttccagtccatcgaatatgctgatgaacaaggccaaatgcagttatccaccttcttttccttcatgttggaaaactacacacatatacataaggaagagctagaattaagaaatcagtctcttgaaagcgaacaggacatgagggatagatgggattatgtggactcgatagatgtcccagactcctataatggtcctcggctacaatttcctctcacttgtacggatattgatttacttcttgaggccttcaaggaacaacagcagatactcatgccattatgtctagaggngtattgaaacaagaaagtctga

SEQ ID NO: 380081 - DNA, 929 bp, Homo sapiens
gaattccgcagagggagggaaggaaaccgccagttaaccacatggtagctgaggggctgctcagcaggattcattttacgcttcttctgaatcgctgtgtattcctcattagaatctatgactgaagaggatcggctaagagtggttcctcgcagcttaaagggaggcacttttcacactctgtcttaaaatcagaagttgaattcatgaacacatatgatttagatagaagtcatgggatgcagcagttcttcaacgaaaaccaggagatctgacacatatacttcatgcccattatgtcttagaggtgctatttgaaaccaagaaagtcctgaagcaaatgccgaatttcactcacatacaaacttctccctccaaagaggtaacaatctgtggtgatttgcatgggaaactggatgatctttttttgatcttctacaagaatggtctcccctcagagaggaacccgtatgtttttaatggtgactttgtagatcgaggaaagaattccatagagatcctaatgatcctgtgtgtgagttttcttgtctaccccaatgacctgcacttgaacagagggaaccacgaagattttatgatgaatctgaggtatggcttcacgaaagaaattttgcataaatataagctacatggaaaaagaatcttacaaatcttggaagaattctatgcctggctcccaatcggtacaatcgttgacaatgaaatcctggtcatccatggtgggatatcagagaccacagacttgaatttactccaccgtgtagagaggaacaagatgaatctggtgctgataacaccaacggaacaaagagaacatgacatgatcgaaagccataaagtacgtgttgctttaatggactggagaatcaaaaatggttctctatgaaattaacgagctgttgggacga

SEQ ID NO: 380082 - DNA, 425 bp, Homo sapiens
caaaaatatcaccatggaatatttttgtttatcttggcctggctgtgcttcatttggctcaagcctgggtctgggattctgtgactctaactcaatgtcaaataccataggcttctttctgccgatgctgtcatccctacttgtgtggggcagtcactcaatccacagcttccctgtaaaaggtactccttaacttcttaaggggcaaagggatactcatcttcaggcaaatttgtaataatttatcaaatgtatatctttgcctcaagatcttggggctagtcaagggttcatatcagaaaccctttgccccagccacactagggcccttaagggtaccatccacaggtcacttgtagtcaacagcacagacaatggccatcgtctcaggaataatgacctcagaccagcagaccaaagtgtcc

SEQ ID NO: 380083 - DNA, 368 bp, Homo sapiens
ctcccgggttcacgccattcttctgcctcagcctcctgagtagctgggactacaagcacccaccaccacgcctggctaatttttttgtatttttagtagagatggggtttcaccgtgttagccaagatggtcttgatctcctcaccttgtgatccgcccgcctcggcctcccaaagtgctgggattacaggtgtgagccaccacacccggcctaaaaatccaagttttaggcaccagctactagtgcagtagccacgtgtggttagagcctccagttctttacagtctcattgtgtggcccaggctggagtgcagtggcacagtcatacatagttcactgcagccttgaactgcctggctcaagggat

SEQ ID NO: 380084 - DNA, 448 bp, Homo sapiens
cattggcattgccagcctcattccatgccactatgagtcaactcaggaaaactgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaaagattgtactttctggactcttttcccactcttgcctctttgtgctgctgtttcgtatcctcctcacaccgtgtatttcccacccactcagggtcacagcctactaattcctcaaacttctctccctggactaggagaaaggctaaagaatgtcagtaaataaaagagctttcatccaaaa

SEQ ID NO: 380085 - DNA, 324 bp, Homo sapiens
gggaagttgttaggtttctagtggaggaattacagaaggtagagagctgagccagtcatccattacaggaaattcagaaataagaattttgctttgactgtaatgtttaaaatttgcagaaacaaaatttacttttatccattacatcaatagagagggttgctgtaagtcttaaaaaggaaggggagtatagatatctaacatgtagccaactgctggctattgtagctgtgacaataagcatgtattgatgacaaaggtagaatatacagtttgaattaactacttaaaataccacaggcccacaagtgacatttgttgtgg

SEQ ID NO: 380086 - DNA, 268 bp, Homo sapiens
tccactttcacagagtttatattctaatggagagagaccaccaacattaaacaaatacatacaaagaattgtaacctttattaaatgttcccaagataagaaaacagtaataacagctgggtgcggtggcttacgcctgtagtcccagcactttgggaggctgaggcgggcggattaccattggtcgggagttcgagaccagcctgaccaacatggagaaaccccgtctctactaaaaatacaaaattagccaggcgtggtggcacat

SEQ ID NO: 380087 - DNA, 4890 bp, Homo sapiens
gtggcgggggcggccatcgtgctgcgcagctgggcgcttggggagccgcccacttcgccgggtcgcgccccgacggccggagcgtggatgcggcggcgcccggagccggggcggacgcggggcggccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggtgcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccaaccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggacgcggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcatacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaaaaaaccacttcgccgggtcgcgccccgacggccgggcccgggagacgcgccggcagccccggcaccttgccaaagtttcaaacccgggaaaataaacgtaagctaaggatcccccccatgtatccaacctcatgctctatgggacccaggccatccccgtgaggttctccagatcctccatgccttggacgaaaggtgttggatcactggtgcatcatgacaccaaatctatagttgaactcatggcaattcagatatcagggctttcatcgagagctgcagt

SEQ ID NO: 380088 - DNA, 359 bp, Homo sapiens
tgggcaattttaaggaggtagacagtgcaataaagaatgatgaggatgtctaccccacatcaaacgcaaatcagaatacccctcctcaatatctttattcatatggaaattctgcattttatactgcttaatcaataacttattaacagagaagttctaaggcagacctaaataaatggaaagatacttcatattcatggactgaaagacccacattgtaaagacgttaattctcccccaagttgagctactgaatcttaaccaaaatcctgaaagtttttgtttctctttatgggacttgacaagcaaattgtaaaatttacatggaagggccgggcgcggtggctcacgcctgtaat

SEQ ID NO: 380089 - DNA, 540 bp, Homo sapiens
aatttaggtggccctctagtttatgaagttccagatcgataggacatggttcttgataccttctgatgtaacacaaatatcatggtgttagaaccatcattgcttacaatctccttccatcatcctttcaaaatgactgttgtccaaaaaaggagactgttgcataatacctggttgacattagcccctgtgattgcaatgggaactcacaagcttggccattcaacatggcatatttctgaaaatactgactttgggggtgattgtatttattctcctatatctgccaagtgagaccacagtgcctctacccggattcatgaggaaggtctatctagaaagaggcaaatacagcagcctctttaattgtagaaatttatgagtgactgtatcagtgaaaagccaagaaagttagaaaataatttaataaaagagagaattcctaaggtattctaaataatgagttttcttcttttatgtaatccatcttgcttatatgtcattttatgcttcagttactttgaatgtttaaaaaaaaaa

SEQ ID NO: 380090 - DNA, 432 bp, Homo sapiens
gtcctgtagaatgggcctttccctacctggaagagggcagctctcatgctgggaccgaataccttgagaggagagcctcttggttgcactgtgacccaggacagggcacagaggaagaagccccattctggtgctccatccctccagtttgcccaaaggttgcacccaaaggccgatgctgggcacagactggcaccttctaactttctctccaagctcccatcctggctggagagacagcaggtgtctgagaactattccttctcttctcagtgagaatctatagccaattagctgagcccagggaggtggaaaatgtctctttccagccctggagctaacagcgaatccagtctttcttgtagacgtctctgtgaagggcgagaacggagtaacctccaggactccaaggagctggtttcaggctgtcag

SEQ ID NO: 380091 - DNA, 411 bp, Homo sapiens
attaatagctggagctcaatggagactgtcggagaactaatttgatagagagaggggtgggagttgcctaaaacccaaactgccctaattgtaaccgtatgagttcctgagaagtttttgcctcccatgacccgctttggcagtctggagaaccctacataccccttcacagaatagtgtttttaaatgctagagataaattatattggattataaattatttcaatgacattgaaatagagttgtcaccatattaagaaaacaaatttttgataaggaagtattttgctttattattaacacatgaaatgacagggtctagaattactgaaagtagtgatacatacagatgatacttttatatatatttgtgaaaactctaacaagataatctgcaacttctaggtatga

SEQ ID NO: 380092 - DNA, 351 bp, Homo sapiens
cttctaaaaaatagaactaaggtgaacgagtgggggtttcatgaaggtaatttggggtccatatgaacaaaagttttttaacacaatcattttaaaatagaaagggctgccttaggaagtaataaattttttaacattaaaaatgttctgacagaagctagctcaccagtagccagaaatatacctgaatattcatctgtagagtggagataattatccaaacggattgttatgaggtttaaatgagataatgcgtgtatggcagttagcatagtgattgacatattgcaaatatgtgcagtgaatgatgaatggtaattgttgatactaccactatcatgaccgcctcca

SEQ ID NO: 380093 - DNA, 486 bp, Homo sapiens
catgcttggcatgggggggcacctggtttttgtgtccttggagctcatctctggtgggggaggaggagcagcaggagatgcgagggctgtagttctcagtcctggccgcacattggaatcctatgggggagctttaaaattatacaccaaactcggccaggtgcggtagctcacgcctgttatcccaacactttgggaggccgaggagggtggatcacatgaggccaggagttcaagaccagcctggccaatatgctgaaacctcgtatctaataaaaattacacaagttagccaggcatggtggcgcacgcctgtaatctcagctgcacgggaggctgaggcaggagaattgcttgaacccaggatgtggaggttgcagtgagctgagattgagccactgcactccagcctgagcaacagagtgagactctgtctcaaaaaaaaaaaaaaaaaaaaatacacacacacacacacacacacacaca

SEQ ID NO: 380094 - DNA, 715 bp, Homo sapiens
tgccctcctcatagggatgtactgcaaaacacataacaaagggttggaaatgcatcaacttctggctgaattatctgttattgtgtattggaccatccccaaactcagtggcataaaacagccatatatttttttctctcactgctgtgagctaactgggattagtgggcaatgcttgcttggggcctcttccccagttgcagccatatggctgaagaagtgggtgttagctaaggcctggctgggctgggggatgcacacgatggtcccttcactcctatgcctggtgcctctgtgtcctccaggtgactctctctctggcagaatagcccagactttttacccactggggtcaagtttccatggacaaggaaagaagcttgcagccttcttaaaagctaggcctggacttggcacagcatcactctcgctgtattctattcatcaaagcacttgaaaccaacccagatatgttcaatggggagcatccatgtatagccccaatttgagacaagctactatcctttaaaagacaggacttgcaagtgatgggaaagaataaaaacccttccacagccatgtctatacatattaattattattttcatctctccccgatatgtatatgttagtttaatgtgttgaataatataaaaccatttatttttttcaaaattgtagaattgaaagaaagggtaataggaggccatgctga

SEQ ID NO: 380095 - DNA, 474 bp, Homo sapiens
agttcttctgaaatcaattcatatattcaacttaattcctgccaaaatttcagtgatacacacacacacacacacacacacacacacggcaaaattgttctaaagtaaattcagaaaataatagagatgagaaaattacaaaaactagtgcaaatactaaaatttgcagatatactaacagatctaacatattacaacatgttatatagcctctgaaataaaaacgatttgttactaggctaaaaataaaatctgcagcccagaagtagaacatattacatatagcactatagtttcataaaggagatggcattggtcaatcagaaacctgaaggtttagtcagtaagtgctctatgagggatcagttagcaatttacaaagaaaaattaatttagagcctcatctcatttcataggccaaaatatattttagataaagaagtaaacattaaaaattaaacaacagaaaccagt

SEQ ID NO: 380096 - DNA, 486 bp, Homo sapiens
tatgcaccaccatacccagctaattttgtattttcagtagagacggggtttctccatgttggccaggctggtctagagctcccgacctcaggtgatccacccaccttggcctcccaaagtgctgggattacaggtgtgaacctaatcctttttgaagatagacccagatgactgtgaaaataatattttaacatgttaacatagatcaggcaatgtatatattaatagcaggcagtgagccgggcactttttaaattgccatttaatccgcagattaactctgagggaagagccaattttctccatttataagtgaaaaaactgatgcttagagaggactcaaaccttggtgtgactctacctaatgctgcttaactttggcaccgcctctttcccaacttccccttcacttttggaatgaaagactgaacaattctgttgcattttctgccttcaaaggataagtgtttgaaatcaagacagaaa

SEQ ID NO: 380097 - DNA, 2173 bp, Homo sapiens
atttttttttttgcttctggaagctttgttctttaatgagccatggggtgatttgttcatcaagctgcttttgtgtagccatacagtgcatattttgagtgacacaaactgcactttatacagatggtatcttgttacccctcaaccccccagcaaagaaaaaaaaacaaaaaggaaattacaaagtgcctattgattgcatccggaatgtaatcagttccgtgggtgagataaatcattcttcttatagaattattctattaaacagtaaaatgttatatttcacaggatatgtccttttataatacagtttttaaaaaaaatttacactcagcatacttataaattacttaaaatccattaaaataatataatacgaatctgtagtccacacctttcccatagtaaatacaaatacttggttcaaaaggtgcaacttttatatgacctcagagggctgataaataggcattaagaatggatgactagcaaggtgacaggcccattgttggggcttttttgaaaatagtttcaaccaggggaccaacatgagacctaatagatccatctccacaatcatcattttgctgttaccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagcgctctggcaggtttccaaagcatgagaagatgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaagcgcctactaccctatgtaaacaacggctttccctcaaagggagggccccacactgctctccactcttatcattttgtggctctctcctcctcacccacccaccccaatgcctggcagattaaattactgagaaatccacaaatctagcaactgaaaaaacaagtttttttaattgaattttatccaaactggagtttcaggtccctggagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaaactctttttttc

SEQ ID NO: 380098 - DNA, 1859 bp, Homo sapiens
atttttttttttgcttctggaagctttgttctttaatgagccatggggtgatttgttcatcaagctgcttttgtgtagccatacagtgcatattttgagtgacacaaactgcactttatacagatggtatcttgttacccctcaaccccccagcaaagaaaaaaaaacaaaaaggaaattacaaagtgcctattgattgcatccggaatgtaatcagttccgtgggtgagataaatcattcttcttatagaattattctattaaacagtaaaatgttatatttcacaggatatgtccttttataatacagtttttaaaaaaaatttacactcagcatacttataaattacttaaaatccattaaaataatataatacgaatctgtagtccacacctttcccatagtaaatacaaatacttggttcaaaaggtgcaacttttatatgacctcagagggctgataaataggcattaagaatggatgactagcaaggtgacaggcccattgttggggcttttttgaaaatagtttcaaccaggggaccaacatgagacctaatagatccatctccacaatcatcattttgctgttaccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagcgctctggcaggtttccaaagcatgagaagatgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaagcgcctactaccctatgtaaacaacggctttccctcaaagggaggggggacaactcgatttccagatttatggggatccatctagagacagacatagc

SEQ ID NO: 380099 - DNA, 1702 bp, Homo sapiens
atttttttttttgcttctggaagctttgttctttaatgagccatggggtgatttgttcatcaagctgcttttgtgtagccatacagtgcatattttgagtgacacaaactgcactttatacagatggtatcttgttacccctcaaccccccagcaaagaaaaaaaaacaaaaaggaaattacaaagtgcctattgattgcatccggaatgtaatcagttccgtgggtgagataaatcattcttcttatagaattattctattaaacagtaaaatgttatatttcacaggatatgtccttttataatacagtttttaaaaaaaatttacactcagcatacttataaattacttaaaatccattaaaataatataatacgaatctgtagtccacacctttcccatagtaaatacaaatacttggttcaaaaggtgcaacttttatatgacctcagagggctgataaataggcattaagaatggatgactagcaaggtgacaggcccattgttggggcttttttgaaaatagtttcaaccaggggaccaacatgagacctaatagatccatctccacaatcatcattttgctgttaccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcaggcatttccgaatcatctccaaggaaatctggtgtttgactatgccatcagcggaggcctagaacagtcactatcatttcaaaaactgccaggatatgcaggtaagtcctacatctccctgagacatgccacccagttaaacacctcctttgtatatgtatatagtcccacctcacagtggggcacaatgcctgccaccctcagaaaatgggttatgggtcagtaagacaacatatattgtgattattggcttttctctgtggtaagtacaggataaaacattaaattaccaaaaaacaaaacaaaacaaaacaaaaaacaaaaaactcaatcacgttgaagagttggtttgataaacaatgtatatggaagctttacaaagacaacaggaaaaaaaagaccttccgtggaagtcaggaatctaagtagcaaagacaactatatttcttatccccttatatttcttatccccatccaggtcactacctgtatgccaaacgatgaaggctaaaattatatggataaaaggacaaaattcctcaagactttgttacttgctgatgtacagtcagtaaattcttaaaagactttgtctta

SEQ ID NO: 380100 - DNA, 1608 bp, Homo sapiens
cgaactagaggatcccgatcagagcataccctttcaatacccaatcaaatgtgggagtcattccagagaaaagtggttaaaagtagtctagggcatagaaaaagaggactctcacagataccaaggagttttactaccaaggccagcatggtattgcaggacagtgctggggagttgtcacaagagtatgggtggacataacacatttgtccatacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagcgctctggcaggtttccaaagcatgagaagatgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaagcgcctactaccctatgtaaacaacggctttccctcaaagggagggccccacactgctctccactcttatcattttgtggctctctcctcctcacccacccaccccaatgcctggcagattaaattactgagaaatccacaaatctagcaactgaaaaaacaagtttttttaattgaattttatccaaactggagtttcaggtccctggagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaaactctttttttc

SEQ ID NO: 380101 - DNA, 1617 bp, Homo sapiens
caaccacccagcttctctccagatggcatcccatcatccgcagcatctctcaacctttatctcctatctcctgcctcatctccttcctaagtaaagaacaccttccaactcaacataaggcagctacaggttggagtgcaatggcgcaatcttggctcacgacaacctccgcctcccgggtataagtgattctcctgcctcggcctcccgagtagctgagattacagaatgatgcatgccccgcatccagcttcccaccaagaagaaaaaagagaggaggatgaggaaagccatggagtgagtatgtatgtttctttttaaaatgaaaactctcttagctttgaacacatcctgagaatcctttcttctttctagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagcgctctggcaggtttccaaagcatgagaagatgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaagcgcctactaccctatgtaaacaacggctttccctcaaagggagggccccacactgctctccactcttatcattttgtggctctctcctcctcacccacccaccccaatgcctggcagattaaattactgagaaatccacaaatctagcaactgaaaaaacaagtttttttaattgaattttatccaaactggagtttcaggtccctggagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaaactctttttttc

SEQ ID NO: 380102 - DNA, 1469 bp, Homo sapiens
caaccacccagcttctctccagatggcatcccatcatccgcagcatctctcaacctttatctcctatctcctgcctcatctccttcctaagtaaagaacaccttccaactcaacataaggcagctacaggttggagtgcaatggcgcaatcttggctcacgacaacctccgcctcccgggtataagtgattctcctgcctcggcctcccgagtagctgagattacagtttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcagggtaagcgctctggcaggtttccaaagcatgagaagatgggggctctagtattccatcccaggacctctggcccttttgtctctctctgcaaggctcatagttggagggctgtatctccctttgtgttttcagaagcccagagtggcaaaataatttaaatggcaggaggtacaaagtacgttgtaaactaagcctccctgaatcctgctgtatttgctgttgatttgcttcaatttgtgatacagaatgaaatcacacttctctgcttttgttacattttccataataagtacatactaaattacagggatacattcactttaatgggcagagttgaaaattcaggttttgtttggggctgggaatgtgtgctgtgagaagagtgctctgcattttggagtatgggctccaaatgtggagctgccccactgctgccatgcagagatcaaacaagcaaaggagaagcactatggaaccacaaatgtgatgcatattaagggctaacagtttcataagtgattgtaatgcggcatcactttgtggtgacataactttaccatgcagagggccagtgagaacagatggatgcagacacagcgtttggttctgaaggtttttaagagttatggcttcatctcttgatcaggccaacaagcgcctactaccctatgtaaacaacggctttccctcaaagggagggccccacactgctctccactcttatcattttgtggctctctcctcctcacccacccaccccaatgcctggcagattaaattactgagaaatccacaaatctagcaactgaaaaaacaagtttttttaattgaattttatccaaactggagtttcaggtccctggagaaaaattataaagtctcttaacatccatcacctagttcctttaaagtgacctacatcagtcgttttttaactgccaaaaaacttattttgccaaaaaagccccacaaagatttagaaggaagaacatgtgccaacatatgttcttctggccattcctctgggccacaggaaattattccataagggcaaactctttttttc

SEQ ID NO: 380103 - DNA, 714 bp, Homo sapiens
ataatgaatagatgccactgttcacacatgaaattgggtgggataagattcagagggtccaggatgacttactatgggcacagtcacagtaagagctcaccatccatttctctatgtagcatttccgaatcatctccaaggaaatctggtgtttgactatgccatcagcggaggcctagaacagtcactatcatttcaaaaactgccaggatatgcaggtaagtcctacatctccctgagacatgccacccagttaaacacctcctttgtatatgtatatagtcccacctcacagtggggcacaatgcctgccaccctcagaaaatgggttatgggtcagtaagacaacatatattgtgattattggcttttctctgtggtaagtacaggataaaacattaaattaccaaaaaacaaaacaaaacaaaacaaaaaacaaaaaactcaatcacgttgaagagttggtttgataaacaatgtatatggaagctttacaaagacaacaggaaaaaaaagaccttccgtggaagtcaggaatctaagtagcaaagacaactatatttcttatccccttatatttcttatccccatccaggtcactacctgtatgccaaacgatgaaggctaaaattatatggataaaaggacaaaattcctcaagactttgttacttgctgatgtacagtcagtaaattcttaaaagactttgtctta

SEQ ID NO: 380104 - DNA, 695 bp, Homo sapiens
caaccacccagcttctctccagatggcatcccatcatccgcagcatctctcaacctttatctcctatctcctgcctcatctccttcctaagtaaagaacaccttccaactcaacataaggcagctacaggttggagtgcaatggcgcaatcttggctcacgacaacctccgcctcccgggtataagtgattctcctgcctcggcctcccgagtagctgagattacagaatgatgcatgccccgcatccagcttcccaccaagaagaaaaaagagaggaggatgaggaaagccatggagtgatttaccaaagtgcttgttacagtgaaaaacacagcccacaggcactgaggtgggactacagaaccttgctggaccacatcttttcagcacatttctgtgaccctctgtttttgatggagaaaacaacgctactgttatgaaacacagaatggagtcttcattaatcttccagcaggcatttccgaatcatctccaaggaaatctggtgtttgactatgccatcagcggaggcctagaacagtcactatcatttcaaaaactgccaggatatgcaggtcactacctgtatgccaaacgatgaaggctaaaattatatggataaaaggacaaaattcctcaagactttgttacttgctgatgtacagtcagtaaattcttaaaagactttgtctta

SEQ ID NO: 380105 - DNA, 325 bp, Homo sapiens
atgtgtcatgggccttgggtgagactcattgctgggctggcttcaggtgtgacccagagcatccccagctgtggtggccatggagaagggattccttctgtttgaagaaaggaaagggaagaataaagggaactttgccttgcagcttgggtaccagcttggccacagtgacgtagagcactaagtggacccctggggtttctgattctagactttggttcctggatgaaatgtttggtcccatcctgggccaaagggaggatactgcccttaacggagaggcacagggctgtcagcattcaccacaagctgaccgaagagccct

SEQ ID NO: 380106 - DNA, 521 bp, Homo sapiens
gttacattgttttgtttaattgcatctgacatccctttaaaattacttatcaagtcattacatctacctgcacttggatgtcctctcctttcctaagtcaacatgtcccaaactgaatccttcctcctcttgcctcgattttccctggcatgacttcatttctgcaaatgacactgcaatttccccaggcagccaggctcaaaccttcatctttcagtgattccctatcaaattcatcatccattctccagtacaaaatttaccagttctttctaccaaactccttctgtagttatttctttcctgcctcttcagctttgcacagggttctccttcataaccttttagtctttggttcaccaacctcctaactaccccctcatccttgaatcagctcaccgtcaacaatgggtcgtcttcctactgtgacagcacaaaccccaattcctgcctttcattcctcatttccctgcctcctcccctggcaatgattccctctagtttaaaaaatatatatatta

SEQ ID NO: 380107 - DNA, 480 bp, Homo sapiens
ccatgctattttgtttagtacagctctgtagcacaatttgaagtcagtggtatggtttggcttttagtatagctttgtagtacaatttgaagtcagtgatatggtttggccgtgtccccatccaaaatctcatctggaattataatccccataatccccaagtgtcaatggggggaccagatggagggaattggatcacgggagtggtttcccccatgctgttcttgttatagtgagtgagtgagtctcacaagatctgatggttttataggtgtttggcatttcccctgcttgcactcactctgtcctgctgccctgtaaagaaggtgcctgcttctcctttgccttctgccatgattgcaagtttcctgaggcctccccagcaatgcggaactgtgagtcaattaaacttctttcctttataaattacccagtctcaggtatttcttcataacagcgtgagaatggactaatagagtc

SEQ ID NO: 380108 - DNA, 539 bp, Homo sapiens
tatagaacccaacactcaataggaagattgtcagagttacattgtaagaagagcatgtagttgggagatatcattgtggccattttgggaaagatgcaacatgtcacaatgtcatgttctccatcgtctccccgttccaccttgtactggtttccaagggtagtcgtttaaaagtaccacaaaaactgggtggcttggaacaacagaaatttattgtttcacagttctggaggccagaagttcaaaatgaagtgttggcagaaacatgctgcctctaaagggactgggaaaggatctgttccaggcttccctcctatcttctggttgttccttgccttctggctgcgtaactctagtcttcatttggtgttctccctgcatgcatggctttgtgtccaaatttcctttttttcatgaggccatcagtcatactggattagggacccactctactactgcaggatgacctcaccttcccaaattacatctgcaacaaccctatttccaaagaaggccacattctgaggtactgggggtta

SEQ ID NO: 380109 - DNA, 366 bp, Homo sapiens
gtccttccctctccctgcgtcctcgagagaaaatattgaatagacaggaattcctgaagtctacacgcctcccatgatgacaggagtgttactgaaagagaacaaagcaaggagatacaatcttcaaggagttagcggggagtgactgtggagcggtcaggagatggctgaaaggctaatatactagacgctaatagtatgaggctaaatctaagagcttaaataatgggccaggaaaaatggtttgggagaggcattgagtggggcaccagcccctggtacaaccagacactgttgtaccactggtttggcaagaaaaacaaccacagtttaagtgtttaagagggctgtaagagttaaagagaa

SEQ ID NO: 380110 - DNA, 378 bp, Homo sapiens
ttttttgagatagagtcttgctttcttgccccggctggagtgcaatggcgcaatctctgctcactgcaatctctgcctcccaggctcaagcaattctcctgcctcagcctcccgagtagctgggattacaggcgcccaccaccacacccggctcatttttgtatttttagcagaggcggcgtttcaccatcttggccaggctggcttcaaactcctgacctcaaatgatctgcctgccttggcctcccaaactgctgggattacaagcgtgagccatcgcaccccacctactgtgctgtagtttaactgcccacttgtttgtatgaattatccaactccttgagggaaaggactatgctttattggctattgcatctc

SEQ ID NO: 380111 - DNA, 410 bp, Homo sapiens
atccatgaccacaacacagaagatttgtctcatttactccagagagaatgattcctctcaaagacaattctcacagctcttccttctcccttagaatatttagaagcaaattagggagctgtcaggtctctgagcccaagcctgcacgtatacatccagatggcctgaagcaactgaagaaccacaaaagaagtgaaaataaccaattcctgccttaactgatgacattccaccactgtgatttgttcctgccccaccttaactgatcaattagccttgtgacattccttctcctggacaattagactcaggagctccccaccagagcaccttgtgacccccgcccctgcccgctagagaataacccactttgaccgtaatttcccactaccaacccaaatcctataaaa

SEQ ID NO: 380112 - DNA, 837 bp, Homo sapiens
aaggggattactgctaaacagacaggcttaccagctgagaaagagaaaaggtaaggctggatcaggccagggattggtgaagggttcccccttaacatccgtttacggagggccagtcaggtgccatgccccaagctgggtcctggtcaggtgtcagtgaacaagactgtcttcacagagcctctggtctaggtgagcagatgttgctcaagaactacaaaagtaaaagtctaatgacagattgaggtacactctgaaaaagcacgtttcatgacaatcttaacagactggacccctgtcacacacacccacacatacacataccccttcccagcatctgcaagcatcacagatgtaccagaattgccctagcccccttgctcctcctccctgtgccaagacatctccagggagaacacacacatgggctcctgtctgcactctcagcagaggagcatgtgcgtgcacacctgcttatctgcagaggctggcctttgagcccctggatctgcgtgtgggttctagtcagtgtgtctgtgggtatggacacgggccctgtccacaatccaagcaggatagcacatcctgcgcaaccacagcctggcctcactttggggcaggagcagctcaaactaccagcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380113 - DNA, 1599 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380114 - DNA, 1353 bp, Homo sapiens
  misc_feature (36)..(36): n is a, c, g, or t
aaatgagcgatagtagaggcccgggttatttagagnatgagggaaagcggtgcccggtaaaagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagcccggattcaaaccggtgtggtccagaggccatcctcttcccactgctaccctaactcaaactgccacatgctcgtgtcctttcagtgggg

SEQ ID NO: 380115 - DNA, 1181 bp, Homo sapiens
gatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccactggggcagcgggcagccacttcgtgggcagcgctgcccacgaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtaaaaaagcaataatgatgtaatatgaaaacacaggcaagctcaaagagaatagcgacagaaagggcggggcgcgagcttatgagaagattaatccccgcagagggggcacaacagattatgctgacacccgagttttgtttgctacaagaggttggcacccacatagaagagagcgcttataattcgaacaggcgagacagacgaggtcaccgcgtgtattatacaaacacgtcctatagcgagggaaaaacaaacggagtgacaagtgggagaccactattgaaaaaagcagcccaccacctcaaacattgtgggtggggtgtaggccaaaaaggatggtggggaaacaaccttcaccacgaagagtaagtataaagacggcctagggcagaaacataattaagatctttgatggaataataatggtgttgaaccaaagacgcgccataaaaatcgtgagcacgcactaaagatatgtgccgccgagagtttattgtcctgacaaacttttaacgg

SEQ ID NO: 380116 - DNA, 785 bp, Homo sapiens
aaggggattactgctaaacagacaggcttaccagctgagaaagagaaaaggtaaggctggatcaggccagggattggtgaagggttcccccttaacatccgtttacggagggccagtcaggtgccatgccccaagctgggtcctggtcaggtgtcagtgaacaagactgtcttcacagagcctctggtctaggtgagcagatgttgctcaagaactacaaaagtaaaagtctaatgacagattgaggtacactctgaaaaagcacgtttcatgacaatcttaacagactggacccctgtcacacacacccacacatacacataccccttcccagcatctgcaagcatcacagatgtaccagaattgccctagcccccttgctcctcctccctgtgccaagacatctccagggagaacacacacatgggctcctgtctgcactctcagcagaggagcatgtgcgtgcacacctgcttatctgcagaggctggcctttgagcccctggatctgcgtgtgggttctagtcagtgtgtctgtgggtatggacacgggccctgtccacaatccaagcaggatagcacatcctgcgcaaccacagcctggcctcactttggggcaggagcagctcaaactaccagtcaggaaagagactaagggcaaagctgagctgctgaagtggctgaggctcgggtgtgtctgcttatctgggcccagttgtgacaggggcagtgaacccaagggacatacttgtcttcctagcctcagagtgagagggttagaagct

SEQ ID NO: 380117 - DNA, 725 bp, Homo sapiens
cttggggacaggtctcagggagctttgggagcaggcatggcacccgatccctgagcttagcacccatccttcaccctccctctgcttcccatccagcccaggtttccctgcccctccccttggggtaaccacccaatgctattgtgccctcatcaggcaaagctctgaatacacaaggcagagggtgcccctggcctttacctgcttggtgctaaatgctctgccatacaggtaccctgcccccactgtttgccctccactcccaccctggacattcttagattggggtaaaaagcaagtgatctctctctctctctctctccctcctttctccccatttctctcccaattctccacctttttacttttcccttctattctcctcctttttttattgatttacttatttttatattggtaccacattcacatagtaggccagcagtgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctg

SEQ ID NO: 380118 - DNA, 1789 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtgccactgtgctcctggaaaaaatctgtttaagcacccagtgtcttgccctgggttttctaggtctcacctgcccacccaaaatcttttctgcaagccccttaagggtgcccaccccagtgcctggccagccctgcacccgtaaaacaccttttagccagtagagggggcccacgagccctctctcaccag

SEQ ID NO: 380119 - DNA, 1746 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380120 - DNA, 1802 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagctacgagtcctcggcggaaatcctgcctcataccccgaggctcacccacttccccacagtctcgggctccccagccagcctggccgactccatgcagcagaagctagctggccctcgccgccggcgcccgcagaatcccagcgccatgtaatgcccagcgggtgcccacctgcccgcttccccctactgccccggggcccaagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380121 - DNA, 1513 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380122 - DNA, 1500 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggagcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380123 - DNA, 1731 bp, Homo sapiens
  misc_feature (1722)..(1722): n is a, c, g, or t
  misc_feature (1724)..(1724): n is a, c, g, or t
  misc_feature (1726)..(1730): n is a, c, g, or t
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcaggtaaggcagagtggggggcagatgtcctcatgggcaccagtgtgcctgctggcagtcagtggaacctgctgggggtatctttacacctctccaggggaacattgttcctgccaccagccccaccccttgcctttttcagcagtacatgggtacctggcctgtggacaccagtgggaaccttaccctgggccaggagccaggggagcgcaaggcatcagagccctctaggcatcccccatccaaatgttagctggatcttaagaatagctgttgtggatttttctctgcctactgtcagaagtcctaggtgactctgcccccaggtgacttcaggcatgtcttcccctcccatggcctcagttttcacatgtgagtaatagaacagggggcgtgtgggatgccctagtgtggtagaaagtgccccgagtagaaggcaggtgtcagtccctgttcattcacctctgtggctttaacccacagctcactgctttctctatatctgtatctcacacagataccccttccccagggccatatccacacctatcacaccccatcctnanannnnna

SEQ ID NO: 380124 - DNA, 1508 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttaaaaattccaaagctgtaacagagagagcaccctcatgctccagctaccccacagaggccagcagtgttacacagacattcagacacctgtgcactgatgtgtgtatactttttcttgcacagacggtggcattcttggagcattctgcacattgggtttctacggtatttcttagaggtgtttccacagcagcacatacacttctagagcatgcttgttcttctgcacagtggcctgatgtgcctttgtctaggtgcatctttcttttttcattctccaaataatatcagcttctttccataaaatctggaagtgcaaaaataggtaaaaacaagacagttctg

SEQ ID NO: 380125 - DNA, 1397 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacaaccggagctggagtcggatcccgaacgcaccctcgccatggactcggccctcagcgatccgcataagcgcagtgccgaggcaggcggccctcaccaagcagcactaccggttcc

SEQ ID NO: 380126 - DNA, 1998 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagggtgggcaggacggtatcagagtgtcaggaatgcctcactgcaaatagagggacttacagagggatttatttgtaaatgcaagcagtccagagataggcactccccactggtgttggagcagtcatgtctgtgattctcttggccttccatttgtggttgcaagatggctgccactgctctaggcagcatgggcacgttagaggcaagaaggagggaaaagcgtaacagccatgcctgctgccttcatcaggaaggcaggaactttcccagaaccctttcagcatctcatgggccagactggggtcctaaagccaccctggctacaggagagtccaggaaagaggatttggcttctcagccttggtagtgggaagcaggcagagaagaacaggattggagtgggtgttgggtattggggcgtccctccccctactccctagtagaccaggctctgcctccttctcccaccaagatgaggatggagtactgagctgccacagaatgaagcaacatagcacaaagactgggagccctcagtgtggcctggagaggggaagattcaggggaaagtgagcagacaggattgccctactttctactggaaataataagagctcctgtttgttaagcacttccacatgtcaggctctgcactcatgaggatccttgtgaacaggtggggaaactggagttcaggtgacacactgcaagtatgtggtaaagccaggattcaaacctgggtcagcatggaaaccacacccaggctctcaagccctggccatgggaaacgcagcattgaacaggggctaagggagccctgttgtgaatcccagcaccacccagtaaccatggaactctgggcttgctgcttctgtcccctttccccttccccagggcccaaatacagacgagccatctttga

SEQ ID NO: 380127 - DNA, 1500 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380128 - DNA, 1704 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtcagaaggcatctctctgcaacatttgaagcagctttctcgggaaccagtacagggtcttggatgagaacatgacttttggcatcattcagagccaggtttgaatccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380129 - DNA, 1877 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380130 - DNA, 1666 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380131 - DNA, 1473 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaaggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380132 - DNA, 917 bp, Homo sapiens
gattatgaaggggctgatggtgtgcgacaggttcaggatcccagcacgaagaaatacatggacactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380133 - DNA, 2582 bp, Homo sapiens
  misc_feature (2356)..(2356): n is a, c, g, or t
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaatgtaagtgaccaccctgccacagggaaccccttcccccacccctgccgggccatgcccccacagcccgtttcagtcagtgcatctccctatctcttccccatgtacctcttcctcctgtggctccccagcctggtttccttatcctcaattgattcatctggctgtgttcatcctgcccaggtcccggcccctggccacttggtcgtggtgcagcatggcgtgaaatgagccaaaatgggagcgagcatggaggggaagtgtttaacccagcccggggggcacgcgcaggggctttccaggagagaaaacctctaagccgagacccctcactggggtccccttggcacctgagtgtcgggtgctgtctatcccgtgcctctcaaactgccttggttttgttcttcagtgtatccactgtttataagtaatagaaaatccacctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgcatggtattacaaggctcagagaggggaacnagaatccgtcaggcatgctagcaaggaagagaggaagatgctgccgggagggcaggcaacagtgagtgcatgccatggaagcactggctcgctggcgatcaggctagtcgttgggggagactgggggagattccactcaggggatcaagaaacagctgtctttctcgtgactcactctaccactgcggacagcctttctccctgcgttgaggagagcttcatggcc

SEQ ID NO: 380134 - DNA, 677 bp, Homo sapiens
ggagccctgggttcaggcccagccactgacttgctatggtcctggaccagtcactgtccttcagtccagcccagaaggggtttggggtgctgggcacggccctgaggcagtgccgtgcccagcatggcttcaccagcctgtgtcctctcatagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380135 - DNA, 1346 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtcagaaggcatctctctgcaacatttgaagcagctttctcgggaaccagtacagggtcttggatgagaacatgacttttggcatcattcagagccaggtttgaatcctggctataaaactcaagggactctttcccctgcacactgtagatgactaggacaagaacaatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagcccggattcaaaccggtgtggtccagaggccatcctcttcccactgctaccctaactcaaactgccacatgctcgtgtcctttcagtgggg

SEQ ID NO: 380136 - DNA, 1996 bp, Homo sapiens
  misc_feature (1770)..(1770): n is a, c, g, or t
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaagtttattttcccaataaaagttatgcaggctcagtgttgaaaacctggaaaacacagaaaagtaaaaagggaaaaacagcagtcatccaaaaccccactaccagagacagtcacagtttcccttcggagatattctcccaggagtacatcaacctcctgctgtccatgtatttcttcgtgctgggaatcctggccctgtcccacaccatcagtgctcttcatttacgatgtcttctgggtatttggcaccaatgtgatggtgacagtggccaagtccttcgaggcaccaataaaatctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgcatggtattacaaggctcagagaggggaacnagaatccgtcaggcatgctagcaaggaagagaggaagatgctgccgggagggcaggcaacagtgagtgcatgccatggaagcactggctcgctggcgatcaggctagtcgttgggggagactgggggagattccactcaggggatcaagaaacagctgtctttctcgtgactcactctaccactgcggacagcctttctccctgcgttgaggagagcttcatggcc

SEQ ID NO: 380137 - DNA, 821 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtcccaaaaggggcgccccctttcccaagttggcaaacatttaaaacggggtttttaataaatatttccccccaaggggcccccaaaagggggcccttttttttttttcccccccaaaaagaagtttcccccggggggaaaacgcatcaacaggggggctttaataaatcaccccaaagaagggggcccctttggggcggatttccccccgttattttcccccagaaatttctataaaacttccaaaacagcgcgggcagcgcggcgcgcatctatattgaccccccttgtgggggggccggaagcgggcggaatcccacgtatagccgc

SEQ ID NO: 380138 - DNA, 407 bp, Homo sapiens
cggcgccctgcgctccgtacgctgcgcccgcggcaaggtagggtcagcgggaaaaccgggcactttccacccccataccgaacacggccgacatggacccttcctaggcgggacagacacctctccccggacactgactcttcccagccctgatcaccaccgttccctctgtctcgggcccacattccggggctggcatttcctaccccgggatctgggcaccgacccccgaccagggtatgataccttccccaataggaacttgcttctgctcccgacccggaccctgacacttccctccctgtgcatcatgccgcggctgggaacgctgtcagcccgtcccccactgcgactcgggcactgattgttctgagcctgttgggcccaggcagatcagccccatcatg

SEQ ID NO: 380139 - DNA, 751 bp, Homo sapiens
ctggggctgagctgtttgattcatgctgtgtgccctgggaggcagcctatctccatctcttgtagccttgtcatggccacccctttttccacgctacagcagaaggttcaggaagcttgaaatcagcccacacaagcccaggcccaacctctcttccattggctgctgcccttgctgcctcctggtacccccaggctcagagaaagcagagcagcctgcctgaggagggcatgtggtagggctggggccaggcgctgttaggtgctgggcagtggacacagggctgacgctctgcatgtgaccaggcgctttcctaggatgggggtgggggaaggggacaaccaaggttctgctcaccctctcctctaaatgaatttttattgttgtttttttttttttggtcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccagg

SEQ ID NO: 380140 - DNA, 282 bp, Homo sapiens
  misc_feature (56)..(56): n is a, c, g, or t
ccagggagcccattaaccctacctgcatggtattacaaggctcagagaggggaacnagaatccgtcaggcatgctagcaaggaagagaggaagatgctgccgggagggcaggcaacagtgagtgcatgccatggaagcactggctcgctggcgatcaggctagtcgttgggggagactgggggagattccactcaggggatcaagaaacagctgtctttctcgtgactcactctaccactgcggacagcctttctccctgcgttgaggagagcttcatggcc

SEQ ID NO: 380141 - DNA, 2085 bp, Homo sapiens
  misc_feature (1613)..(1613): n is a, c, g, or t
  misc_feature (1625)..(1625): n is a, c, g, or t
  misc_feature (1627)..(1627): n is a, c, g, or t
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtaaaaaaaaaaaaanaaaaaaaaaaananaaaaaaaaaaaaaaaaaaaaggggggggggccaaaaatcccccggggggggccacatattgcacgcaccaccccacttgttcggtgatcaaaggggggcccccaataggggggctcgtaattaaaagccaggagggcaagcggcagccgtgcagtataaaacacctgcggtagtgcggggaaaaactggtgtacaacggtgtgggcgtatcttgtgggagcacagagagaaaccatatctcgtggtggggggggagaagaccataatggtgggacaaacaactactcccgcagaggaagataataacagaccggcgctaaggaggaaaaaatataaaaatctttgaacaggggatatcaaattgggtgtagaacaccaggcggtaaattattggtgtgggatatagaaagttgtttgcctcgagaggattgttactttgagaacaatgtttatccggg

SEQ ID NO: 380142 - DNA, 2116 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtaaaaaagcaataatgatgtaatatgaaaacacaggcaagctcaaagagaatagcgacagaaagggcggggcgcgagcttatgagaagattaatccccgcagagggggcacaacagattatgctgacacccgagttttgtttgctacaagaggttggcacccacatagaagagagcgcttataattcgaacaggcgagacagacgaggtcaccgcgtgtattatacaaacacgtcctatagcgagggaaaaacaaacggagtgacaagtgggagaccactattgaaaaaagcagcccaccacctcaaacattgtgggtggggtgtaggccaaaaaggatggtggggaaacaaccttcaccacgaagagtaagtataaagacggcctagggcagaaacataattaagatctttgatggaataataatggtgttgaaccaaagacgcgccataaaaatcgtgagcacgcactaaagatatgtgccgccgagagtttattgtcctgacaaacttttaacgg

SEQ ID NO: 380143 - DNA, 2115 bp, Homo sapiens
  misc_feature (1643)..(1643): n is a, c, g, or t
  misc_feature (1655)..(1655): n is a, c, g, or t
  misc_feature (1657)..(1657): n is a, c, g, or t
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgtacaaaaaaaaaaaacaaaaaacgaacaaacaaaaaaaaaaaaanaaaaaaaaaaananaaaaaaaaaaaaaaaaaaaaggggggggggccaaaaatcccccggggggggccacatattgcacgcaccaccccacttgttcggtgatcaaaggggggcccccaataggggggctcgtaattaaaagccaggagggcaagcggcagccgtgcagtataaaacacctgcggtagtgcggggaaaaactggtgtacaacggtgtgggcgtatcttgtgggagcacagagagaaaccatatctcgtggtggggggggagaagaccataatggtgggacaaacaactactcccgcagaggaagataataacagaccggcgctaaggaggaaaaaatataaaaatctttgaacaggggatatcaaattgggtgtagaacaccaggcggtaaattattggtgtgggatatagaaagttgtttgcctcgagaggattgttactttgagaacaatgtttatccggg

SEQ ID NO: 380144 - DNA, 1728 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaagtttattttcccaataaaagttatgcaggctcagtgttgaaaacctggaaaacacagaaaagtaaaaagggaaaaacagcagtcatccaaaaccccactaccagagacagtcacagtttcccttcggagatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380145 - DNA, 2650 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccgtaagtggggaattattgttttttagacaaagaaaggggcctttttgtccaactctaaggttgcttcacaaatacccttttatcctgccacaccagcaggttgataaaggagctatcaaatttgtactcagtggcgcaaatattatgtgtccaggtttaacttctcctggagctaagctgtaccctgctgcagtagatacgattgtagcagtcacagcggaaggaaaacagcatgctctgtgtgttggggtcatgaagatgtctgcagaagatattgagaaagtcaacaaaggaattggcattgaaaatatccattatttaaatgatgggctgtggcacatgaagacatataaatgagcctcagaaggaatgcatttggggggctaaatgtggatattgattgtgtcgtatgtgtgtttgtgtctgtgtgtgacagcgtgaatacaatgcctctgtggttatgctaaataagtttaacagatactttatagaaaacaaatcagggtgctcttaccacagatgaaaaaacaaattaggggacaagcagcaagcagtctgctaacactctggaatgtgaaaggagtgtctggactctgtgactcccggcaaactccacagcctctagttgtcttcttaggaagcttggaagcaattgagaatggtctaacatcaagatgtctaccacagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380146 - DNA, 1189 bp, Homo sapiens
aacttacgctaggtacgagcctgcggtgaaatcggccgaggattcttcgtgctgggaatctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380147 - DNA, 1451 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380148 - DNA, 1642 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380149 - DNA, 1345 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccagataagaaaactgaagctcagagagggcactgccttccccaaggtcacccagctacaagtaacaaagcctgtgcttctaacaccaaagaccacttcccgctgacactgtgccaggcttagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380150 - DNA, 2524 bp, Homo sapiens
cgtctggcaggccgcgtggcgcccgcgccggccttcctgcaggggactccaccggagccttgccaattccgtttgtttccctgttgtcgcccgcttcaccctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccgtaagtggggaattattgttttttagacaaagaaaggggcctttttgtccaactctaaggttgcttcacaaatacccttttatcctgccacaccagcaggttgataaaggagctatcaaatttgtactcagtggcgcaaatattatgtgtccaggtttaacttctcctggagctaagctgtaccctgctgcagtagatacgattgtagcagtcacagcggaaggaaaacagcatgctctgtgtgttggggtcatgaagatgtctgcagaagatattgagaaagtcaacaaaggaattggcattgaaaatatccattatttaaatgatgggctgtggcacatgaagacatataaatgagcctcagaaggaatgcatttggggggctaaatgtggatattgattgtgtcgtatgtgtgtttgtgtctgtgtgtgacagcgtgaatacaatgcctctgtggttatgctaaataagtttaacagatactttatagaaaacaaatcagggtgctcttaccacagatgaaaaaacaaattaggggacaagcagcaagcagtctgctaacactctggaatgtgaaaggagtgtctggactctgtgactcccggcaaactccacagcctctagttgtcttcttaggaagcttggaagcaattgagaatggtctaacatcaagatgtctaccacagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaaagacctgggctcagaggcagctggcactgactgagcacccactatgtgccaggcactgtgctgaatgcattgtaaggactgtcttacttattcccccacagcagccctaagaaggggtgctgttatcccctttttacagataagaaaactgaagctcagagagggcactgccttccccaaggtcacccagctacaagtaacaaagcctgtgcttctaacaccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaaggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380151 - DNA, 1324 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtgctcttcatttacgatgtcttctgggtatttggcaccaatgtgatggtgacagtggccaagtccttcgaggcaccaataaaattggtgtttccccaggatctgctggagaaaggcctcgaagcaaacaactttgccatgctgggacttggagatgtcgtcattccagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380152 - DNA, 898 bp, Homo sapiens
ggtgaggtgctgggtcattgtagtcccaggccaaagcaaaatcctgggcccctctcattgttctaggtagagaaatgggactttctgctgtcacttgagagtattggccacacccttggtctccaatgattgctccaagatggaacaccaggttggggaccaggacccagtctcctgttagttcactgccctgctgcttccctgccactctctaaccccagctttctcccacagggatcttcattgccttgctgctgcgctttgacatcagcttgaagaagaatacccacacctacttctacaccagctttgcagcctacatcttcggcctgggccttaccatcttcatcatgcacatcttcaagcatgctcagcctgccctcctatacctggtccccgcctgcatcggttttcctgtcctggtggcgctggccaagggagaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380153 - DNA, 1169 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagccccttcatgaataagttttttccagccagctttccaaatcgacagtaccagctgctcttcacacagggttctggggaaaacaaggaagagatcatcaattatgaatttgacaccaaggacctggtgtgcctgggcctgagcagcatcgttggcgtctggtacctgctgaggaagcactggattgccaacaacctttttggcctggccttctcccttaatggagtagagctcctgcacctcaacaatgtcagcactggctgcatcctgctgggcggactcttcatctacgatgtcttctgggtgagtcaggcagggatgccaaggatgtctggctccggggccatctcatctcatcaccctgcctctctggcccaagttgcagtcatctgacggagaagagctgttttgggctgaagttccggaccgcagagcaagtcctctctgggcccatctgtgagatggagccagagagagcagattctacctctttctgagagcacactcatgcccggtgccttccgaccacctgcctctcttccttgctagcaggggtgttacctaatcccatgtctccttggcaagggagttgagactcaaagaagttcaggtaggggtggaagaatgttgatgaatgggcccagcaagggcattcacattcactctgagaggcatcaca

SEQ ID NO: 380154 - DNA, 664 bp, Homo sapiens
gatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccactggggcagcgggcagccacttcgtgggcagcgctgcccacgaagtgacagagatgttcagttatgaggagtcaaatcctaaggatccagcggcagtgacagaatccaaagagggaacagaggcatcagcatcgaaggggctggagaagaaagagaaatgatgcagctggtgcccgagcctctcagggccagaccagacagatgggggctgggcccacacaggcgtgcaccggtagagggcacaggaggccaagggcagctccaggacagggcagggggcagcaggatacctccagccaggcctctgtggcctctgtttccttctccctttcttggccctcctctgctcctccccacaccctgcaggcaaaagaaacccccagcttcccccctccccgggagccaggtgggaaaagtgggtgtgatttttagattttgtattgtggactgattttgcctcacattaaaaactcatcccatggccagggcgggccactgt

SEQ ID NO: 380155 - DNA, 1285 bp, Homo sapiens
tgggaggcacgaggaacccttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaacagcactacgcggccgccttccacgcccgagggcatcgcgctggcctacggcagcctcctgctcatggcgctgctgcccatcttcttcggcgccctgcgctccgtacgctgcgcccgcggcaagaatgcttcagacatgcctgaaacaatcaccagccgggatgccgcccgcttccccatcatcgccagctgcacactcttggggctctacctctttttcaaaatattctcccaggagtacatcaacctcctgctgtccatgtatttcttcgtgctgggaatcctggccctgtcccacaccatcagtcagaaggcatctctctgcaacatttgaagcagctttctcgggaaccagtacagggtcttggatgagaacatgacttttggcatcattcagagccaggtttgaataatgacctctctgggccacagtttccttatagacatgatgaggatctggtgggtgtttccaccaccacagctgttgggaaagtgatttgtgagcagtaatgtcatgttagttgtgacagtactcaggtgagtaacaccagtaccacctgccgggtgttgtggcctagctgtgtgctaagtgccatgttgggctcctcacacatgatcgtgtttcgtaaggagccagaggcagcatagtgaaaagttaggagcgtgggctctggcatttgactaccttactttgagtccagactctgccacttaatagctctgtgatcttgggcaagttacttaatctctctggcctcaatttcctggtgaatgtggagaaaaataatagtgcccttcccatggggtcatgtggaaagcttttagcacagtatctggtgatttaaagtgttcagtaactattagctgttactgtcattatctgtgttaacctgccagacaaccttatatgggttgcttttgctttcacacctgtatgatagtcatggaaactgaagcccagagaggttaagaaatttgctaggatcacaccactaataagcaacagagcccggattcaaaccggtgtggtccagaggccatcctcttcccactgctaccctaactcaaactgccacatgctcgtgtcctttcagtgggg

SEQ ID NO: 380156 - DNA, 263 bp, Homo sapiens
aacttacgctaggtacgagcctgcggtgaaatcggccgaggattcttcgtgctgggaatctggccctgtcccacaccatcagccccttcatgaataagttttttccagccagctttccaaatcgacagtaccagctgctcttcacacagggttctggggaaaacaaggaagagatcatcaattatgaatcccacaccatcagccccttcatgaataagttttttccagccagctttccaaatcgggcaaagtgcaggaattgg

SEQ ID NO: 380157 - DNA, 438 bp, Homo sapiens
agtctgtttctcactggagcgcaggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380158 - DNA, 344 bp, Homo sapiens
agcggccgctcgcgatctagaactacccacgcgtccggcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380159 - DNA, 6519 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcaggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380160 - DNA, 7582 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtaacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaattcatcatgttgcaga

SEQ ID NO: 380161 - DNA, 6537 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380162 - DNA, 6102 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctacctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380163 - DNA, 6543 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380164 - DNA, 5733 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagttgttgaacaaagctggtcatttgt

SEQ ID NO: 380165 - DNA, 4852 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactactgaggtgtaagcgcttacacctcagtagtactcatgtttagtcgggagaggagtcatgaa

SEQ ID NO: 380166 - DNA, 3009 bp, Homo sapiens
gctgttacgacccggatattacgggcgtatggcgcctacagttgtgttgatcactgctacagcctacacactgaggaaggagggtgaacagctcgaatgactagaggacacgtcatgtgatcattcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380167 - DNA, 2841 bp, Homo sapiens
  misc_feature (50)..(51): n is a, c, g, or t
  misc_feature (63)..(63): n is a, c, g, or t
agcggctgagctgccacaagcagatggggttgaagtcacagcaacaccgnnttctaattgcantgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380168 - DNA, 2375 bp, Homo sapiens
atataaaatgtgtattttaaacacagcagttgagctgagtgcattttctatagtactactgaggtgtaagccttagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380169 - DNA, 2688 bp, Homo sapiens
gcagcgctgctcaacacggcgcaacgacttgcacggcccgcaccactcagcccacacatcaccagcaacggcaggtcgcccttgatctaggctggcatagtcgccttgtttcagctcgaaaggcttgttcagcaacacaggctgcttgcagcgcccgcatttaggcgcatcacccaggcgttcgccaggaatgcggttgagaccgttgcaatgcgggcaggggattacaagaggttcggacatggtgggctcctagggcgtggccaatgggtttaatttggagccggcaatgaggtttatcaagaccaggcgaaaaggatgaaacactgatcgttcccacgctccgcgtggtaatgcatcccgtggtactactgaggtgtaagccttagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380170 - DNA, 3330 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagctggcacatctgctagcaaaatattcctcgagggcagcgccactgcggggatcctct

SEQ ID NO: 380171 - DNA, 3414 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccaggtaaagagaaccagtaactgggcctgtacatagtgatagggtgtggtggggtgtgtgtgtgtgcgcgcgcacatgcacgtgtgcatgtgtgagctagggtgctgtgtatgtgtgtgtaagtgtgtgtgtgttggttcttaataggggatagagaaaatgtctccagaatctgttgttaatctgaatagtggaataagaaccagcttatatatacttgatgaagcagcaaagtagtcgttttggcttttacactgttttctgcagtcctcaagttttatggcactgattcacaagggtttgagataggctgagctggatcctagcctctgctttagccagagaaggtttacttttctgatttgtgttgggttttgagtaagtttgcatctgggaaaaaggcatttt

SEQ ID NO: 380172 - DNA, 679 bp, Homo sapiens
tgaaaagcgctatggctgcttctgaaactcaactgctgctggcatgagtggcttcctctgcctccactcaatcgcagagtgcgtccttggatggtcctgatacacaatggctaaaagaacaaggagaggagataaccaagtttcagcctcaaaaagatgacccaccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380173 - DNA, 1839 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggtatgtgcctctgcctgctttatcagtaagggaataccatgggcttgcacaagagtatttccaagaatgaacatggtgtgaagacacatagtgattatctttaccagcctggtctgtcttaggaaggcacacactaatcttttttttaaacatgcatgtacatatttgccttcccctaccctcaagctttattctgcagccattactttacttcggagatgaaggaaggtcaaccagatgatttgcatccagtcgtttaccaacagttttctaagaccctatattatgtgatgtgcatccaaaagacattgtgcttaatcatgggggttggttaaagaaatgattgtatagtcttacagtgaaatgccatgtaccaattataaatgttatatttattgacagggaaggagtgagtggaatacatcacca

SEQ ID NO: 380174 - DNA, 1612 bp, Homo sapiens
ctcctttctttctccctatttctgtttgtttgcctctgttttgctcaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtaacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaattcatcatgttgcaga

SEQ ID NO: 380175 - DNA, 711 bp, Homo sapiens
gcagcgctgctcaacacggcgcaacgacttgcacggcccgcaccactcagcccacacatcaccagcaacggcaggtcgcccttgatctaggctggcatagtcgccttgtttcagctcgaaaggcttgttcagcaacacaggctgcttgcagcgcccgcatttaggcgcatcacccaggcgttcgccaggaatgcggttgagaccgttgcaatgcgggcaggggattacaagaggttcggacatggtgggctcctagggcgtggccaatgggtttaatttggagccggcaatgaggtttatcaagaccaggcgaaaaggatgaaacactgatcgttcccacgctccgcgtggtaatgcatcccgtggtactactgaggtgtaagccttagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccatgactaagtcaaaatataagtaaaataaaaaatcaaatccctgtatattggtaatgttacaaacaggcctaatcatctcccagagaatatctagaaaatacccctagtcttctggagtatctgtgtcagagtactactgatgt

SEQ ID NO: 380176 - DNA, 454 bp, Homo sapiens
gaaatcaaggttttttctatgatggcaggggccttattgtttttattgattgctgtatctccaatgcttaggactatgtctggcacatgataggcattgtggaaatgaatgaactttcaggtagcagaagtatcctcagaaaactctaaagatgctaggcagattctggctaggatgtaaaagaatatagaaaaccttcactgccataataacaccaagaaaaatccagatgatgtagaagtcacacttactctggcagtattggaattatttactgctgtataacaaattgcctcaaaacctagtagcctgcaacagctacttatttattatagtcttggattctgtaggtcataacttcagatggacttagtagggatggcttgtcttcacagtatctgtgatctcagctggaagaagggaagactggaggcaggagtcatctgaaggctca

SEQ ID NO: 380177 - DNA, 440 bp, Homo sapiens
gttcttgcatttgaattgctaacatcctcttttcccttttttcttcctattttgatttggtttctcattgctcaatgtcttctcttcctgtctcctcctttctttctccctatttctgtttgtttgcctctgttttgctcaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtaagccccctggggagggcccttgggaacccacacgccagccaaaaagcactaggggcctgtactcttgctctgaaaagaaatttgaccatgaggtgaaggcccctcccttgaaatttgtgaaca

SEQ ID NO: 380178 - DNA, 556 bp, Homo sapiens
ctggaagagggggaggtttcttcagtggccttggaggaaaacccagtcaggatgcagccaacaaaaacccattcagctcggccagtgggggctttggatccacagctacctcaagtaagttgagaagacttttcccagtcccttggtcccctaatgccattgtcattcttagggtgttatcaaagcttcagtgacaaatataaaaagaaaaaaaaatctagaaggctcatttaaaatatcttccccaaagcagtgtgatctgttttgcttttttatttttggttttttaatgagatgtcctatataatcatgaaaagatatcagagctgcagggagaggatctgtgtattgagctgctcccctcttctctcccaaggcccaaatcgctctgtttcttagtattggagtgacttgaagtgaatgcaagcagacaagcataaatgagcagcagcagagcaagccgaggatgctgggaggagagcatgcagactttcatttggatagtactctccaaattttccttaaaattcagctcctgtagggagatgtcacccaa

SEQ ID NO: 380179 - DNA, 456 bp, Homo sapiens
atcaaggcactcacaaagtcccatccaggttcaagaggagatacagaggccgcctcttgctctagaagagcatatgtgactagaagtattgctgtgatcatctttggaaaatatctgtcataatgggaccattgaagagtggcagaaagccttgttgaactggtttccagagagtggagcccatcataggtgtgagcactgtggcacagcagctgctgggggcagatgccaggtctgggtttgagcaggtagtagagaggacttgccaaagactgagaaaatgtactggctggagaaggagctgttggcagtgatgggggcaagcaaaataaatgaccagtaattacatgaaaaggtgatcaagtagcattaaactaatgagggaaatgaaaatcaaaaccacaattagataagataccacttcacaccccctaggatggctatcatttaaaaagt

SEQ ID NO: 380180 - DNA, 6604 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380181 - DNA, 6711 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaatagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtccctggccatgagcctgtctccgaccctgaagggcaggctgttgctgatgaggcccaaggcaggaggaggaagggagcaggccgctcctgggagaaagtccaatgagagcagatcccttggccacctttgtatggaaagagccttgacctcaccattaaaagtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380182 - DNA, 654 bp, Homo sapiens
tgaaaagcgctatggctgcttctgaaactcaactgctgctggcatgagtggcttcctctgcctccactcaatcgcagagtgcgtccttggatggtcctgatacacaatggctaaaagaacaaggagaggagataaccaagtttcagcctcaaaaagatgacccaccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggaggtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380183 - DNA, 4825 bp, Homo sapiens
  misc_feature (4809)..(4809): n is a, c, g, or t
  misc_feature (4811)..(4811): n is a, c, g, or t
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactactgaggtgtaagcggggntnctcaggaaacagct

SEQ ID NO: 380184 - DNA, 6940 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtagaacaaaaaaaaaaaaaaacaaaaaaaaaaacatcttgtcaggcgacgacacggaccctctgaaaaaaagttcacaaccactttggtgtgatggaaccgcggaccccacagatgcgtaatggacacacgcgggcaaacagctggtacaccgtggagacatccatggacaagcaaagagggggagaaggggatacactcacactattaaaaacagcccccgcgggggcggcccgccggggggtctccgagcacacgtccccagaagagggagcctactaggaggcccaagacaggcgggactcctatcaggcgggaggtaccgagggagacccccga

SEQ ID NO: 380185 - DNA, 6508 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtaagtatccccctttttgagtctcaccttaattaaaagcattaaataaggttggaagtgtgtggatcttgctggatttgtgcattttcttttcgttttttcctgtttttagagtttgtcctggaagtgtgggggttcagcagcagggtttgg

SEQ ID NO: 380186 - DNA, 6408 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggaggttcagctttgggtcaaataactcgtctgtccgcttttggtgcatcgataagaccggatcctctagatgaacgcagca

SEQ ID NO: 380187 - DNA, 5873 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagtatctgtgatctcagctggaagaagggaagactggaggcaggagtcatctgaaggctcactctgatgtcagtggttggcttggtgtggcccacctttgcgggccgttcttgacctctttggctgttgcgggtcccccggggggctgccggggctcccaagggcct

SEQ ID NO: 380188 - DNA, 6420 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagtatctgtgatctcagctggaagaagggaagactggaggcaggagtcatctgaaggctcactctgatgtcagtggttggcttggctgttggctcagaccttagctggagctgttagctgaacacctacatttggcctatgtagcctgggcttcctcacaacgtggtggctaggttccaaggaggaacattccaagaaagaggaagagccatgctgaagctgtataaccttttatgacctatcctcagaagtcacagaacatcacttaggctgcatcctcttcatcaaggcactcacaaagtcccatccaggttcaagaggagatacagaggccgcctcttgctctagaagagcatatgtgactagaagtattgctgtgatcatctttggaaaatatctgtcataatgggaccattgaagagtggcagaaagccttgttgaactggtttccagagagtggagcccatcataggtgtgagcactgtggcacagcagctgctgggggcagatgccaggtctgggtttgagcaggtagtagagaggacttgccaaagactgagaaaatgtactggctggagaaggagctgttggcagtgatgggggcaagcaaaataaatgaccagtaattacatgaaaaggtgatcaagtagcattaaactaatgagggaaatgaaaatcaaaaccacaattagataagataccacttcacacccc

SEQ ID NO: 380189 - DNA, 5902 bp, Homo sapiens
agtggactctagagaagccccagctgcttcagctggtgttgcaacagagactgctgctgcgcgggaagtatcttagtactttggaggacggacaagctattccttgacctccgttttacaacgtagatactggtgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380190 - DNA, 5029 bp, Homo sapiens
ggaaaacaagctatgacacaatgagttacagaatttcgagctccggtaccccgtctgaacaatgctgggaaccagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380191 - DNA, 5885 bp, Homo sapiens
gtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctgtgtgctggagccccaaaggaaagcagctggcagtgggaaaacagaatggaactgtggtccagtatcttcctactttgcaggaaaaaaaagtcattccttgtcctccgttttatgagtcagatcatcctgtcagagttctggatgtgctgtggattggtacctacgtcttcgccatagtgtatgctgctgcagatgggaccctggaaacgtctccagatgtggtgatggctctactaccgaaaaaagaagaaaagcacccagagatatttgtgaactttatggagccctgttatggcagctgcacggagagacagcatcattactacctcagttacattgaggaatgggatttagtgctggcagcatctgcggcttcaacagaagttagtatccttgctcgacaaagtgatcagattaattgggaatcttggctactggaggattctagtcgagctgaattgcctgtgacagacaagagtgatgactccttgcccatgggagttgtcgtagactatacaaaccaagtggaaatcaccatcagtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggacgatctgctcagggcagttcaagcccagtgccctcaatggtacagaaatcacccaggataacccctccagcggcaaagccaggctctccccaggcaaagtcacttcagcctgctgttgcagaaaagcagggacatcagtggaaagattcagatcctgtaatggctggaattggggaggagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggaaattcggcgccttcatcagtatgtgaaatttgctgtccaagatgtgaatgatgttctagacttggagtgggatcagcatctggaacaaaagaaaaaacaaaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacagttttgacagtgacctggaaagcctgtgcaatgctttgttgaaaaccaccatagaatctcacaccaaatccttgcccaaagtaccagccaaactgtcccccatgaaacaggcacaactgagaaacttcttggccaagaggaagaccccaccagtgagatccactgctccagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccagctgtaaacactttgactgaatcaacgttgaagaatgtccctcaagtggtaaatgtgcaggaattgaagaataaccctgcaaccccttctacagccatgggttcttcagtgccctactccacagccaaaacacctcacccagtgttgaccccagtggctgctaaccaagccaagcaggggtctctaataaattcccttaagccatctgggcctacaccagcatccggtcagttatcatctggtgacaaagcttcagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcagcaccctgagaatggagacagtgtttgaagagatggatgaagaaagcacaggaggacgtttcatcttcgaaagcaagaaatagtccttggccagagatccatctaagctttccttttagcattatcttctcaactgttctctactgtggtgaggttgccttgggtttatacatgtttgaacatttatcgaaaagctaatgacacattctgggatgtcatttaccatccaggttattatgtggggccact

SEQ ID NO: 380192 - DNA, 3232 bp, Homo sapiens
tgagaaggaggtatctagcacttctcgaccggggcctaaagctttatgttaaaaggaaaattatatagtagaactgtcaaagacttgagtattttacaaaaaggttttgaaagatcatatactcttttttcaaggacttcattggagaggtttttgtcactcttggagttagaatcaaagaaacctaaggaactttgctttatgcatgtctgggcaagtagtgtgacttgcaagaaatttccgagattcaccattcattgctgatcatgaaatcctctcttttgttacgaggtgttcacttctgttttcacttgccagggacagccaagatagaaacagctgtgacttcaaccccatctgcttctgggcagttcagcaagcctttctcattttctccatcagggactggctttaattttgggataatcacaccaacaccgtcttctaatttcactgctgcacaaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagtaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380193 - DNA, 1772 bp, Homo sapiens
tgtctggggagcctggactgctgtgggaagctgtagattcctgactgacgcctggcatggtggtactgccagggaatgccgctgtgtgcgatgagcctgcccggctgtgcgaggagcagcattcttcactgacgcctgagctagacgtgcagtcgggctacagtgccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggttttgggtctagtaatactggttctgtgtttggtcaagcagccagtactggtggaatagtctttggccagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaaatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtttgggagcagcagcaacaccacatccttcggcacgctcgcgagtcagaatgcccccactttcggatcactgtcccaacagacttctggttttgggacccagagtagcggattctctggttttggatcaggcacaggagggttcagctttgggtcaaataactcgtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgta

SEQ ID NO: 380194 - DNA, 6432 bp, Homo sapiens
  misc_feature (1071)..(1071): n is a, c, g, or t
atgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacantgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagactttaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatgggaaaagtctgtccagcgattcagttgttcccctccttccaaaaacagcctccaataccacaacctggaaaagaggccgaaatgggttatttttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaacagattgtgtaaaagttcaagcccgttttagaaagccaacattttatgttataatatgctgttaatcaggactttattaaataaaaacattggctcttccaacccccac

SEQ ID NO: 380195 - DNA, 6466 bp, Homo sapiens
  misc_feature (1071)..(1071): n is a, c, g, or t
atgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacantgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagactttaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatgggaaaagtctgtccagcgattcagttgttcccctccttccaaaaacagcctccaataccacaacctggaaaagaggccgaaatgggttatttttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaacagattgtgtaaaagttcaagcccgttttagaaagccaacattttatgttataatatgctgttaatcaggactttattaaataaaaacattggctcttccaacccccac

SEQ ID NO: 380196 - DNA, 2216 bp, Homo sapiens
  misc_feature (1071)..(1071): n is a, c, g, or t
atgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacantgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatag

SEQ ID NO: 380197 - DNA, 1007 bp, Homo sapiens
cagctcttcccattgctcaagatgcttgtacccgtgatgcttcttttctctgcttaggtcacaatatgtggagctgacaaggttcccctattatcagtgacaatggtggaatgtggaggtgaagttaacaccttcgtggctacagagtttccttagcagagctgtggagtgtgacaatggtgtttgtgtctaaactatcaaacgccattatcacactaaatagctactgctaggcaatccttccctcgataaatgtcttggcatcgtttgctttgagcaagaaggttcatctgatatcagtcttctcaatcttgtgtacttactgaataaagtctggttcttttgcactcataaccaatatggttagctgaaccctgcctctcacatgctgttgttacataccttagctggtgattaattttcttgttttcccaagtcaataaaaagattgcagaccaggcacggtggctcacgcctgaaatcccagcactttgggaggccaaggcaggcggatcacttgagctcaggagttcaagtccagcctggggcagcatgggtgaaaccgtgtctctacaaaaactacaaaaattagccaggcatggtggcatgtgcctgtaatctcagctacttgagaggctgaggtgggaggatcaattgagccccacgaggttgaggctgtagtgagctgtgatggtaccactgcactccagcctgtgtgacagagcaagatcctgtctcaaaaaatgaaaataaaaagattgcagagttcctcagagcccccaacacaaggccaggcacgaggtaatcatttaacccatgcttatagacttaaaatgaatagttaggaaagtgttagacgcagaaggctaagactgggctaaatctatgttatgcagacagaccgcaagcttataggtacaaaattaaggtgtgtgggtccttctcttttcgtcgttaaaaaatccaactttctaataaacttacacatggtttcactgacgtttcag

SEQ ID NO: 380198 - DNA, 378 bp, Homo sapiens
agctcggtttttggagacatgaatccgccgatgctcccagctgaataaagcccttgcctttcacaacttggtgtctgaggggttcttgtctgcggcaagatcctgtctcaaaaaatgaaaataaaaagattgcagagttcctcagagcccccaacacaaggccaggcacgaggtaatcatttaacccatgcttatagacttaaaatgaatagttaggaaagtgttagacgcagaaggctaagactgggctaaatctatgttatgcagacagaccgcaagcttataggtacaaaattaaggtgtgtgggtccttctcttttcgtcgttaaaaaatccaactttctaataaacttacacatggtttcactgacgtttcag

SEQ ID NO: 380199 - DNA, 796 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380200 - DNA, 986 bp, Homo sapiens
  misc_feature (826)..(826): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttactgaaaaaaaaaaaaaaaacagaaaaaaaanaaaaacaaaaaaaaccggggggtctttttggggggggggggaaagaggggaaaaggggaaggggtaggttttccgggagcccctttttttaaaagggggaaacggggcgccccaaggggggggtttttgcgcggcgctgttttcttttcggaggggggac

SEQ ID NO: 380201 - DNA, 828 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380202 - DNA, 817 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcaggtgtacatttttatctttcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380203 - DNA, 3972 bp, Homo sapiens
  misc_feature (52)..(52): n is a, c, g, or t
  misc_feature (82)..(82): n is a, c, g, or t
  misc_feature (189)..(189): n is a, c, g, or t
  misc_feature (360)..(360): n is a, c, g, or t
  misc_feature (456)..(456): n is a, c, g, or t
  misc_feature (556)..(556): n is a, c, g, or t
  misc_feature (672)..(672): n is a, c, g, or t
  misc_feature (850)..(850): n is a, c, g, or t
  misc_feature (944)..(944): n is a, c, g, or t
  misc_feature (966)..(966): n is a, c, g, or t
  misc_feature (1086)..(1086): n is a, c, g, or t
  misc_feature (1125)..(1125): n is a, c, g, or t
  misc_feature (1147)..(1147): n is a, c, g, or t
  misc_feature (1277)..(1277): n is a, c, g, or t
  misc_feature (1324)..(1324): n is a, c, g, or t
  misc_feature (1431)..(1431): n is a, c, g, or t
  misc_feature (1453)..(1453): n is a, c, g, or t
  misc_feature (1870)..(1870): n is a, c, g, or t
gttctagaacattctcatcacccatatttacatttatttttaataactctcntgtgtaagctgagtgttttaaactttaganacttctggggggtgctgaacttgataaaaatattcagtatacaagtgttctttatagttcactcatcattttcatagaattagggttttaaaattagaaagtaattnaggccatttccatctcctgtccctcaaatcccagctcagttttgggatgaggtgtcaagtataagtttgtaagtatgccagtcatttgcacggctaagagaaacatctagagaagtctatatacgacttgcttaaagctgaatgttgatttactgttcacatgatttgggngattttagtcactgggactgagctaatggagttgaagcattgttgcgggcattgtacctccagaccagtgtgtaatacaaagagttcttgcagacntaggacagaattggagaaacagcttctaacagtgggaagactctcagtacaaccaagctattccttacctttctgatttctgaacttttttccatgtganacctgctgctttgaaggcactaaaataacagaagcagatagagcagaaatcctcactcagatcttcctccttcctacctgtataacagtttgtggcttgccttgtctgttttgtgngtttcgttacgcgtatgtgagtatgtgcacgtgatttccagaaaggagaagcgcacgatactgcccgtgctctgtgactcctgagtgcatgcttcctctgcatttgggctcctaggtcggcctcgtcctgtggacgttgccccttgtttcgtgccatccacacattcctgatgccccnctgctctactctttctccagagtactttttccaaacatgtgatttgcacatttgttatgtttattgtttgttttccacttctagaagtgtgccnctaggcaggaatgtttgatttnttcactgatgatcccagatctctagaaccctgccttgcctgtagagggtgcttggtaaatgtgctctgaatgaatggctccatgatcctcgtttctaagagctagcacgatttctcactnagtcctggttggacacaggttccctggaacagtgctgtngtggttatcttctcacgtgtcnttgtttctgaacttgaaacgctttgagttttttattgtttttgttcttcctcattagtttgagtcccttgcagataggctttcattttgtccagtcacctgttcagggagccctgagggccttggcccangtctgcaggtaactggtttttttatttttatttttttattttgagangaagtctcgctctgtcaccaggctggagtgcagcggtgcgatctcagctcactgcaacctccgcctcctgcgttcaagcgattctcctgcctcagccttccgagtanctgggactataggcacgtgccnccacgcccggctaattttttgtatttttagtagagacggggtttcaccatattagccaggatggtctcgatctcctgacctcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacctacatggattttcaaagatttattcaatntgtttttcagaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380204 - DNA, 638 bp, Homo sapiens
  misc_feature (608)..(608): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgcacgtgaccaacttgcgcaagatgggagcgcccgaatctggcttggcggaatatctctgtgacaagcacancctggcagaagcagaagcggtccgagccga

SEQ ID NO: 380205 - DNA, 792 bp, Homo sapiens
  misc_feature (589)..(589): n is a, c, g, or t
  misc_feature (615)..(615): n is a, c, g, or t
  misc_feature (624)..(624): n is a, c, g, or t
  misc_feature (664)..(664): n is a, c, g, or t
  misc_feature (671)..(671): n is a, c, g, or t
  misc_feature (677)..(677): n is a, c, g, or t
  misc_feature (721)..(721): n is a, c, g, or t
  misc_feature (724)..(724): n is a, c, g, or t
  misc_feature (728)..(728): n is a, c, g, or t
  misc_feature (735)..(735): n is a, c, g, or t
  misc_feature (744)..(744): n is a, c, g, or t
  misc_feature (747)..(747): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtgggaagacggtttttgggcggtgccatgtttttttcaatcggtttcaaccgcgcttcgttaatccattgttggcaagaaagcactattgtgttaacgggccccttcccgcaaaagcttttgcaaaanagttgggttgcccaagcaagaccaangaggattcnttgacaattaagggtgaaccccatccaagggtttagcctncaaagtngggctntcggaaagaaccgagttgaaagaagttaagaaaatcttgccttncancttnaaccttnaccttggtnttntaacccgcaattaaactccaatccctttttacttggaaccctttt

SEQ ID NO: 380206 - DNA, 1172 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaaaaaacaaacacaaaaaaaaaaaaaaaaaaaaaaaaaaaaacaaaaaaaaaaaaaaaaaaagaggggggggaatgggggggggggaaaaaaggggtaaaaaggggcccaggggatcaatagatgattcccagcaacccccacgttttgtgaacagaggggaaaaagagcgggcccccaccaagaagggggccgacaaaacatggcaaaacgagagggttcaccctctttaattgttcgctcgtgcaaaaaactaggaactcagaccgctgtagcacagtcataatagagggagagcaccaccgagatataacaacatgatgacgaaaacgactgacaaacgagaacgagacaacataacccaga

SEQ ID NO: 380207 - DNA, 1026 bp, Homo sapiens
  misc_feature (883)..(883): n is a, c, g, or t
  misc_feature (911)..(911): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaaaaaacaaacacaaaaaaaaaaaaaaaaaaaaaaaaaaaaacaaaaaaaaaaaaaaaaaaaaaaaaaaaaaaaanaaaaaaaaaaaaaaatttaaaaattttntaaaataatataaaaggcggcaattgggggccttttggcaatttgcccttatggggggggtttacaattaatgggcgggctttttcaccgggggtctgggccctctggttccccc

SEQ ID NO: 380208 - DNA, 907 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgtaaataattctataaatctgatgaagaccctaagtgggggcccggcccccaatttcacccttttgggaactcgaattcccatttccctggcccccgtttatacaaatg

SEQ ID NO: 380209 - DNA, 2439 bp, Homo sapiens
  misc_feature (52)..(52): n is a, c, g, or t
  misc_feature (82)..(82): n is a, c, g, or t
  misc_feature (189)..(189): n is a, c, g, or t
  misc_feature (360)..(360): n is a, c, g, or t
  misc_feature (456)..(456): n is a, c, g, or t
  misc_feature (556)..(556): n is a, c, g, or t
  misc_feature (672)..(672): n is a, c, g, or t
  misc_feature (850)..(850): n is a, c, g, or t
  misc_feature (944)..(944): n is a, c, g, or t
  misc_feature (966)..(966): n is a, c, g, or t
  misc_feature (1086)..(1086): n is a, c, g, or t
  misc_feature (1125)..(1125): n is a, c, g, or t
  misc_feature (1147)..(1147): n is a, c, g, or t
  misc_feature (1277)..(1277): n is a, c, g, or t
  misc_feature (1324)..(1324): n is a, c, g, or t
  misc_feature (1431)..(1431): n is a, c, g, or t
  misc_feature (1453)..(1453): n is a, c, g, or t
  misc_feature (1870)..(1870): n is a, c, g, or t
gttctagaacattctcatcacccatatttacatttatttttaataactctcntgtgtaagctgagtgttttaaactttaganacttctggggggtgctgaacttgataaaaatattcagtatacaagtgttctttatagttcactcatcattttcatagaattagggttttaaaattagaaagtaattnaggccatttccatctcctgtccctcaaatcccagctcagttttgggatgaggtgtcaagtataagtttgtaagtatgccagtcatttgcacggctaagagaaacatctagagaagtctatatacgacttgcttaaagctgaatgttgatttactgttcacatgatttgggngattttagtcactgggactgagctaatggagttgaagcattgttgcgggcattgtacctccagaccagtgtgtaatacaaagagttcttgcagacntaggacagaattggagaaacagcttctaacagtgggaagactctcagtacaaccaagctattccttacctttctgatttctgaacttttttccatgtganacctgctgctttgaaggcactaaaataacagaagcagatagagcagaaatcctcactcagatcttcctccttcctacctgtataacagtttgtggcttgccttgtctgttttgtgngtttcgttacgcgtatgtgagtatgtgcacgtgatttccagaaaggagaagcgcacgatactgcccgtgctctgtgactcctgagtgcatgcttcctctgcatttgggctcctaggtcggcctcgtcctgtggacgttgccccttgtttcgtgccatccacacattcctgatgccccnctgctctactctttctccagagtactttttccaaacatgtgatttgcacatttgttatgtttattgtttgttttccacttctagaagtgtgccnctaggcaggaatgtttgatttnttcactgatgatcccagatctctagaaccctgccttgcctgtagagggtgcttggtaaatgtgctctgaatgaatggctccatgatcctcgtttctaagagctagcacgatttctcactnagtcctggttggacacaggttccctggaacagtgctgtngtggttatcttctcacgtgtcnttgtttctgaacttgaaacgctttgagttttttattgtttttgttcttcctcattagtttgagtcccttgcagataggctttcattttgtccagtcacctgttcagggagccctgagggccttggcccangtctgcaggtaactggtttttttatttttatttttttattttgagangaagtctcgctctgtcaccaggctggagtgcagcggtgcgatctcagctcactgcaacctccgcctcctgcgttcaagcgattctcctgcctcagccttccgagtanctgggactataggcacgtgccnccacgcccggctaattttttgtatttttagtagagacggggtttcaccatattagccaggatggtctcgatctcctgacctcgtgatccgcctgcctgggcctcccaaagtgctgggattacaggtgtgagccaccgcgcccagccctgcaggtaactgttaatgtaggaagtgctgcctctgggcaccttggccccagggttcattagcagttgcccctggtgggtttttgttggctgtgatgagaagtgcttctgttccccctccaccacactcctgcaactgtttaaacagtggctgtgaccccctgagatgatccagggtttcaaggcgtgcacatgtctgtgtttcggttttcagaagtatcaccttggggtgactctcaacctacatggattttcaaagatttattcaatntgtttttcagaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380210 - DNA, 710 bp, Homo sapiens
  misc_feature (675)..(675): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagttgnagaaattgcttgggccttgcggccttgcaccttgc

SEQ ID NO: 380211 - DNA, 1193 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcaggtgtacatttttatctttcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaaaaaacaaacacaaaaaaaaaaaaaaaaaaaaaaaaaaaaacaaaaaaaaaaaaaaaaaaagaggggggggaatgggggggggggaaaaaaggggtaaaaaggggcccaggggatcaatagatgattcccagcaacccccacgttttgtgaacagaggggaaaaagagcgggcccccaccaagaagggggccgacaaaacatggcaaaacgagagggttcaccctctttaattgttcgctcgtgcaaaaaactaggaactcagaccgctgtagcacagtcataatagagggagagcaccaccgagatataacaacatgatgacgaaaacgactgacaaacgagaacgagacaacataacccaga

SEQ ID NO: 380212 - DNA, 1700 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380213 - DNA, 617 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaaggagtgctgacgttggtaccgagcc

SEQ ID NO: 380214 - DNA, 1425 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380215 - DNA, 1383 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380216 - DNA, 1580 bp, Homo sapiens
ggtgagacaggaggtggacgagggcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380217 - DNA, 627 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatcgacatgaatcatgtcggtgctttcatgccaccgtcctgctgtctatatcaaccaacaccttttctggggatgaagggcctcgacattgaa

SEQ ID NO: 380218 - DNA, 1278 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtatagagggcagaacgcttggtcctctggacatggcgttcatcctagacttgcccatctgcgggcctcttcggaatctccgtcctctcgggggtctatccgtagtat

SEQ ID NO: 380219 - DNA, 1376 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgctagaaacaactaacatgatgacttacaggtatcatcatacttaatgtctgtagactgaaagctttccatcttaataacagagcacgacacggatgctatcagcacttctattcagcactatattgcttgttctaggtgccatgagttatatggaatacagacgcgctgtttatatgatacagtaactctatatttaccgatgtcacgaacttacctgcctaataatcctacgccattcacaccgattgtcagtaacctatgagatcagcaatcaggacgtagcatgcatatgaccttacaataggtcttatctctatatggctgatacgcataatctcggatttgacattatcactggttcttcttatctttgcttatcactactcatttacctactcccg

SEQ ID NO: 380220 - DNA, 170 bp, Homo sapiens
gcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacc

SEQ ID NO: 380221 - DNA, 676 bp, Homo sapiens
ggtgagacaggaggtggacgagggcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380222 - DNA, 956 bp, Homo sapiens
  misc_feature (810)..(810): n is a, c, g, or t
  misc_feature (812)..(812): n is a, c, g, or t
  misc_feature (814)..(814): n is a, c, g, or t
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaanananaaaaaaaaaactccggggcttttttgggggggggaaaagggtttaaatgggccctggcaccagggtttccggacccgctttttgtaaaagggggaaatggggggcccctagggggcgggtatatcgaagagccgggtcctga

SEQ ID NO: 380223 - DNA, 176 bp, Homo sapiens
cgtccgccacagcttctcattatgataactctcattttcttagtcccacttggaggctaggatgctggacatgaaggtgaaccccatccagggcttagcctccaagtgggactacgaaaagaacgagtggaagaagtgagagaagctgtgcggccgagaagctgtgcgaccggtag

SEQ ID NO: 380224 - DNA, 1144 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctggcctagttggcaagcgagcaattttccacctctgtgtgtgtacgagctcatgaaagtgtgtgaagagcgaagacttttcgctcccagcttatatggatcggcgtgaccaccccttgccggaggtggccatgtcaaagcacctgtctgaccaggcagaacggcactgaaggagacaggagaaggactccctggagcaggcctgcccatggcatgacgacacgccacagagggcatccgcatacagcgtccaccggaggagcgagcagagatgaccgaggggcgccaacagtgggaaaacgcagtgagcagaggcaggcgctcaacgggacacgggccccagccagc

SEQ ID NO: 380225 - DNA, 919 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgtagagacggggtttcaccatattagccaggatggtctcgatctcctgacctcgtgatccgcctgcctgggcctcccaaagtgctgggattacaggtgtgagccaccgcgcccagccctgcaggaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380226 - DNA, 726 bp, Homo sapiens
tggacgaacgtacgaacgcaccttccatggccgtgtaatccggacaggcgatgcagcggcgggtggtgggcgaaattgtgcggagcttcgagaggaagggcttcaagttggtggtgctgaagctggtgcaggtgggggcgcggactccgaggagctgctgcgtgagcattactccgagctacgtgttcgggcacgtggacggacacgtatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380227 - DNA, 1110 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380228 - DNA, 2329 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtgggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccctaactactttgtacagcacaccacgttttcagtagcaatttatgtgctcaccagtcacttagcaaaagatgacttcgtgaaggttcgagcaaggataaggggactcattcatttaatgactgtctcgactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacgacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaaaaaaaagtcgaaggccgaaaaaaaa

SEQ ID NO: 380229 - DNA, 773 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380230 - DNA, 707 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380231 - DNA, 1427 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagtgtgggtattgaagggacccacaggcgcgcccagcagctctcggaagcgtgtgtgtgacagagcctctgctcacttctgggcctactgtctagagagcagtcttgcacaggagggttgctctgctgggtttcggggtcactgtgccagggccccagtttatgtgctcaccagtcacttagctctgccagctgacaggatcttttgctgggcccccttctctgtgctgagtggaggtagcctctcagcatatctgctgggtaagacatagttaactgtaaattattgaaagaaactcagcaaaatgcatagtgtttggtatgaaaggggcagaaaaataacaagattaaatagaccctaatactgtaattcaagtaagaaataattttgcagttttaatttgcacctgaagcgaactgtatgcattttcttccttccttgccctgtcacatgcctgcgtgggcacgtgtgtgcacgtatgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatgtgttaccggcccccttcccgcaaactttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttac

SEQ ID NO: 380232 - DNA, 430 bp, Homo sapiens
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggagacctgccaatttatgtcaagactgtatttgcaaaggga

SEQ ID NO: 380233 - DNA, 454 bp, Homo sapiens
attcagccccctacaggcagcgatcctgcactgtgcttgtcacccacccccatgcctgaccctgaggtggggaagcctcagacacaggcactgtcaagtcaaggaagggcgtggctcccgggaccccttgtaactggaggccgagtctgtctgaggtatttctattgtagaaaatagaaataagcctatcccctcaagtaagtgtctgtgtgtgtgtgtgtgtgtgtgtgtgtgtgtgtgtgtttactcaataagatcagatggcagtttgttcagtaatttgcttcagaaagagggttttacagctgggtgtggtaattgtacctttagtcccagctactcacgaggccgaggcaggaggattgcttgagtttgaggctgtactggccatgatagagtctgtgaatagtcactgtgctccagcctaggaaacatagcaagaccccatctctaa

SEQ ID NO: 380234 - DNA, 679 bp, Homo sapiens
gcggccgcctactactactactgctcgaattcaagcttctaacgatgtacggggacatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgcaaactccagttgtctcaaagtttctccaaagaggtatgtacatatttcaaaaagataatgttacctattttaaaccattttgattttatgtctaggtgaaatgctgactcatagcccttgattgctgttttagagtttaggcaatcctctttaaaaaatgtgcttgaggtacctggggagaataacaatttcaagtacatgaagggttattaagcagaaggtgataggcatctttgcttaatttccagagaggctacaacaagggaaaaggcaaatgaagtcgtggatatgaaaataactataccttggctttctgtagctcttctggcccaaggtgctcaaagaatcttcaacagatattttatcttcacagtatatgtatgatgaggatagcgctgtggaaagtaagacaatgcttaaggaatttccccaaggtcacacaagagggaggactaatttctatttt

SEQ ID NO: 380235 - DNA, 2057 bp, Homo sapiens
  misc_feature (520)..(520): n is a, c, g, or t
  misc_feature (840)..(840): n is a, c, g, or t
cttgctacagccaaatggcatctcactttttaaagacgtttgcaattattagttgattcacagtacagaacaaggtataaaggaaaaaaccctgctaggtagtgttacacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctgtnatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgca

SEQ ID NO: 380236 - DNA, 526 bp, Homo sapiens
agactctgctagggttagcagagcagccggtaacgttgctggaccgggacgcacgctcagctgaggaggacccccaaagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagctgtaagtgaaacattaaaacagaacagaaaacaaaa

SEQ ID NO: 380237 - DNA, 551 bp, Homo sapiens
gtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattgcaggcgtgcgccaccacgcctgactgg

SEQ ID NO: 380238 - DNA, 3544 bp, Homo sapiens
  misc_feature (2007)..(2007): n is a, c, g, or t
  misc_feature (2327)..(2327): n is a, c, g, or t
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtaacgtcagcccggcagctctcgttatcctccggcgtgcggggcggttttttccgcgttgtctcggtgactcgtccgctctgtgtctccctctgagaccggcggtccggccgcggggataccgggtcagcttgaagctggccgcggtggcctgcctggctgcgcttgtcttttcggtccagcatcaccgttccccagcgccagttgtagcacccgagaggaagagcgtgtctcccttcttggggggaccacaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctgtnatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgca

SEQ ID NO: 380239 - DNA, 2060 bp, Homo sapiens
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagtgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggtt

SEQ ID NO: 380240 - DNA, 1166 bp, Homo sapiens
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggatctacgactctggctccactgattaccttaaccatattacatggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagctgtaagtgaaacattaaaacagaacagaaaacaaaa

SEQ ID NO: 380241 - DNA, 377 bp, Homo sapiens
ggagcggggacacctccgggcgcgagggggctgtgtctgggctgcctgttggctgggaaggagaacgcaccagggccgctgtatgagttgagcgctcggggatcccgagggtggtcgcggcagcaatgtgatcgcgaaagaagccggtgggagaaccggtcgaggggctaggtgtcttgaccctaagggctggagtccgccgagaagaggctgactggggcacagggtcggctgataaacagcgtggtccgttcttcctcctggactacgggaaagtctggcttcacctgtgcacaacaggtaggcgtggactctgcccgccagcgggagccggggttgccgggcgtgtggggaaggtcagcaagtcggagcccgcc

SEQ ID NO: 380242 - DNA, 696 bp, Homo sapiens
gtgggatttacttactaaataaaaagaacaggaaggtaaaatcttctcatgtattcccccaggggaacaatatttgaggttccagtgtacagttaattctttagacctttctggatgaacttattgttaggttatcttaactgccaattcagatttaaaatatcatgccattttctgcatgaaaattgccttatttttcatgcttagattatttagcttagtgaagcagtattttaaatctaaatagagactttgggttagaggcatgagctgacaaactgaattttaaacatgagatttgctgactaaaaacttgatggttttcttcatgtttgtttttcactttaaaatgttttgcctttcttcctcacccagttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagt

SEQ ID NO: 380243 - DNA, 593 bp, Homo sapiens
accggtcgaggggctaggtgtcttgaccctaagggctggagtccgccgagaagaggctgactggggcacagggtcggctgataaacagcgtggtccgttcttcctcctggactacgggaaagtctggcttcacctgtgcacaacagatttttattgttaggtatattgaccaaagtttaacgagaagaactgtgatcagctgggaggattgctgcaaggaatggaattagctcatagcttactgctgaatgaagaagcatacaatcaactaggtgaagttcagaaggcagagtttatttttgagtggttgagatacttggagaagctcttgttggcaaccagcaggaatgatgtaagggagaaacagaagactcttgttgaacagctcctgtctttgttgaacagctccccagggcctcctacccgcaaactgcttgctaagaatctagccatactttatagtattggagacacattctccgttcatgaagcaatcgataaatgtaatgatcttattcgtagcaaagatgattctccaagttatcttcccactaagctgtaagtgaaacattaaaacagaacagaaaacaaaa

SEQ ID NO: 380244 - DNA, 3290 bp, Homo sapiens
  misc_feature (1753)..(1753): n is a, c, g, or t
  misc_feature (2073)..(2073): n is a, c, g, or t
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctgtnatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgca

SEQ ID NO: 380245 - DNA, 3149 bp, Homo sapiens
  misc_feature (1753)..(1753): n is a, c, g, or t
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgca

SEQ ID NO: 380246 - DNA, 3755 bp, Homo sapiens
  misc_feature (1753)..(1753): n is a, c, g, or t
  misc_feature (2073)..(2073): n is a, c, g, or t
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctgtnatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggttaatggtctatttttcagtttttaccaaaatcatgtgtctcactttttgtcttcgctttttaaagaactggttcatgaaattagtgttagttcataaattgtttaagaagttccttttccattgaattagattgctgtaaaagggagaaaaagggaagcttcccataagaatagtttgaaaacaaattgacttgttcatttccatattatctgcttgatgatatggagccagtgtcaatttttctgttagtgaatgttttggactagatgttcccgtccccaaaatttatatgttgaagcccttattaatgtgatggtatctggagatggggctcctccaaccatcccatcctggaacatataagccagaaagaaagtagtctccagaaacagaccatgctgacaccttgagtttgaacttctaatcaccagaactgtgaggaaataaatttctggtgtttaaaccacccagtcctatggtattttgttagggcagtctgagctacgacagtgatataagatagatagctagtaaggtaaacttttcaaaggcaagagaggaagatatacaagaaattgaaagaataattaagtcagtaagaggtaatattcagttttggcaaactcctctgacttgagttgaaaatacttttttttttaagagtaaaaaccaaataactaattctaattggcaaaaaaaggtaaataaataaacatcctaagtagctgctgaaatttccgttgtgtcttatagtttctttaggtctgtgttcctaagatgcttaaaatttttatcatgaaaaatcctattttctctatacccttcctgtactgttctattttggaaccagagaatcaataactggcttggtaatgagctcattgtccttaacttttgctttattgattcacaatacacttactgaaatgtaataaactattcataaacttgcaaactccagttgtctcaaagtttctccaaagaggtatgtacatatttcaaaaagataatgttacctattttaaaccattttgattttatgtctaggtgaaatgctgactcatagcccttgattgctgttttagagtttaggcaatcctctttaaaaaatgtgcttgaggtacctggggagaataacaatttcaagtacatgaagggttattaagcagaaggtgataggcatctttgcttaatttccagagaggctacaacaagggaaaaggcaaatgaagtcgtggatatgaaaataactataccttggctttctgtagctcttctggcccaaggtgctcaaagaatcttcaacagatattttatcttcacagtatatgtatgatgaggatagcgctgtggaaagtaagacaatgcttaaggaatttccccaaggtcacacaagagggaggactaatttctatttt

SEQ ID NO: 380247 - DNA, 2337 bp, Homo sapiens
  misc_feature (1753)..(1753): n is a, c, g, or t
  misc_feature (2073)..(2073): n is a, c, g, or t
acgtcatatgcatcagaataagctgttttatttttgtattagtagcgggctaagttattaacaatcatactttcttggataagaacatttttaacaaggatatcttctaaagaatgtgtattcgtatagcataccaataccttttcacaactgtggaatcagaataatttatggcattcccgatagaggaggcagcattgtttttattgattggaataaggaaaattttgaaggatgtatatatagcttttagttccatctccgcttgctttatgattcgattatttgtttacttactttcatatgggcataacatgaatttaaatcaagcagatttaaaatttttcaacagttggaacctaagctttctgaggtgaaaaatgtttcttaaaaggtttgtaggaaagagatttaacgagtcttttcaatcgtttaataaaagtatacactgagcgccttctacagagttgggcaggtgctgccgagaagcttagcgctacgccggcctccaagaccgcacatccgggacattcgagagtcagtccgaggccccgccctcctaagggcggggccactgggcaatcggcgcaggcccttcgtcgtgccccgcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtcgcggcccagtgggtggaggtccaaagaggactggtgatctacgtgtgctttttcaagggagctgataaagaacttcttcccaaaatggttaatacactgttaaatgtgaaattaagtgagacagaaaatggcaagcatgtctctatattggatctacctggcaacattcttattatccctcaagctacccttggaggaagactaaaaggaagaaacatgcaatatcactctaactctggaaaagaagaagggtttgaactttactctcaatttgtgactctatgtgaaaaagaagtagctgctaatagcaagtgtgctgaagctagggttgtagtggaacatggcacttatgggaacaggcaggtgttaaagctggacaccaacggaccattcacacacttaattgagttttgaaaatgaaaaactagtttctatagctgttttctggtatgaaatgatctaaagtataattagattttcttccccttaatcttgaatatactaatcttcagcatttttagacaggaaaatcttgggtttcatatataactctgcacctgctaattggatgactttgccaagtcacctaaactctggatctcagtcaccttttgtcctacattcctctacccttctacttgaaaatttgaaatatgctgtctattcacttcatagtcattaaggaaatgttcttaattgtttttttgtttttgttttttttttgagatggagtcttgctctgtcgccagactggagtgcagtggcgcaatctcggctcactgcaacctccacctcctggattcaagcgattctcctgcctcagcctcccaagtagctgggattacaggcgcatgccaccatgcccagctaatttttttgtatttttagtagagatggggtttcaccgtgctggccaggatggtctcgatctcctgacctcgtgatccgcccacctcggcctcccaangtgctgggactacaggcatgagccaccgtgcccggcctcttagttgttttttaaaaattatgtacattttaagtattttgcaatgaagaaattcatgcaaacaagaaaaacacatttcttataccatcaaatttgtgtagcatgtaataaaaataactatttgtattaaaattaggtaaacttcagcacaacccaattataactttgttaattttgtttactatttcagttttctgtatttccatatgtaagtcaccatttcttttaataatatgcatgaaaatgtaatatagggccaaatgtggtggctcatgcctgtnatcccagcactttgggaggccgaggtgggaggatcacttgagcccaggagtttgcgaccagcctgggcagaatagcaagacccagtctctaacatatacatatacatatagatatatatgtaatatagaagggttattgtgtgttatattactttccagggacattcaaatgttttacattactttaagaatctttacttgatataagaacaaagtataagggtttaaaagttgtttttattaaacatactatataaatgggtt

SEQ ID NO: 380248 - DNA, 3495 bp, Homo sapiens
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380249 - DNA, 3443 bp, Homo sapiens
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380250 - DNA, 3353 bp, Homo sapiens
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttgggggggtgcttattctactcgttaaagtccccccgtaagcaacgaaaaaagttgtttataaatttatattagcagccagttacaacgtagtcacgctcagggggtttt

SEQ ID NO: 380251 - DNA, 573 bp, Homo sapiens
  misc_feature (27)..(27): n is a, c, g, or t
  misc_feature (41)..(41): n is a, c, g, or t
cagcccgttactgcgctaacattatantaaacttcaaccanaaaaacattgtgactaacattaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380252 - DNA, 1666 bp, Homo sapiens
  misc_feature (1469)..(1469): n is a, c, g, or t
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcagtgatgctcaaggtttgcattgaccaccactgtctggcttgtgttccttgaggccagtggcttacatctgtcaaatggctggcctggtctgaaagaacaatctctggcaggacaactgagaangaatgacgattgaaaccctgtccttggcactgtgaactagccagctaagccaatcagcacagccaccttggtttaagcccttaaaagagggttgtactttttaaaactatgcttaaaattgaaaatatctactagaaacagaagagaaatattgtctccattgcttgccattctttcagctcagatcatatatatta

SEQ ID NO: 380253 - DNA, 293 bp, Homo sapiens
atggcatctggctggttcaggtatgaaaagcagtaataatttgataattcgagagccctaaaaaaattatttttaccaaaatagtatgtaccagccagtgacacttccgtgtccttgtgtcttgtttctcacacataactcagttctcttagggaggctccagtatcttcttaaaaaggttttggagactgaggaagatgaaaattgagtagtgggaaagagaaagatgggggatgggggtcaactttttgtttagaatccccagaagcaaatctattttagttattggacct

SEQ ID NO: 380254 - DNA, 609 bp, Homo sapiens
gaacattgtcttgtacctgccccaggtatgttcccaactcttttcactcacttctactatctctgctataaccaagaggtacctgggaagaacccctctcattcctccttcttttcctaacattggagctcttatcacatgtctcaaagatacctgtgcagtgaacaagatcttcactgaaagatgcctccagacttaggaactaaatatttacactggcgaggcaacctctaaactccttggagcagtgtcattctgcacacagacctgaaatgtttgggttatttgcaaccttgatcaagaaatgggataatgcctgaaaagtgagttatttttaaaagagggcaaagagtagagagtatggtagtatgattgcacagatacttcttaatcttcctaaggaatctgaaaaataagttaaacttgtctttgattatttgaccaaaagaactaccagattgactcttgagtggtagcaataaaaataaaataaaataaagaacaagaggcaataggcgcctgctttgcttgatcttcctaattttctaggtacaacttttttttctctcttttttttgagatggagtcttgctctgttacccaggctgg

SEQ ID NO: 380255 - DNA, 502 bp, Homo sapiens
gaaacacagaaatacaaaacaaactagaaaaacagagcttgtttttcacagctgccaagtagtggtaccactttttgattatttggaaattatttggctttggggtgaggtgctaaagaaatttgtcagggaagataaattgtttgcattacagcctagctgtttatttacagtttcctctcttgtagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttg

SEQ ID NO: 380256 - DNA, 2507 bp, Homo sapiens
ttgttatgtctcggctccggccgcggccgccgctgatacacggttgtggagggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380257 - DNA, 3441 bp, Homo sapiens
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcatagcaaatgacagaagtcccttggtgggcaaaattcactgggagaaaatggttaaaaaggtgtcaagatttggaatacgtacaggcacatttaactgttccagtgatcccagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380258 - DNA, 1670 bp, Homo sapiens
ttgttatgtctcggctccggccgcggccgccgctgatacacggttgtggagggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcagctctgtcagtcagggatccttaaactcttcaaaaccaaatgctagaacacgttgctgaataaataaggccctggcattgaacattgtcttgtacctgccccaggtcatagcaaatgacagaagtcccttggtgggcaaaattcactgggagaaaatggttaaaaaggtgtcaagatttggaatacgtacaggcacatttaactgttccagtgatcccagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaaaaaaaaaaaaa

SEQ ID NO: 380259 - DNA, 1644 bp, Homo sapiens
ttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatg

SEQ ID NO: 380260 - DNA, 1998 bp, Homo sapiens
cagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatactcctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttggccagctttagtttgaggactccttgataagcttgctaaactttcagagtgccctgagacacttccagccatccctcctcctgccttcattggggcagacttgcattgcagtctgacagtaattttttttctgattgagaattatgtaaattcaatacaatgtcagtttttaaaagtcaaagttagatcaagagaatatttcagagttttggtttacacatcaagaaacagacacacatacctaggaaagatttacacaatagataatcatcttaatgtgaaagatatttgaagtattaattttaatatattaaatatgatttctgttatagtcttctgtatggaattttgtcacttaagatgagctgcaaataaataataccttcaatggaaaac

SEQ ID NO: 380261 - DNA, 1442 bp, Homo sapiens
cagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatactcctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggaatctttggagacttagtggcatctaatcttggggcctcagacacccgaaatctatatatgaccag

SEQ ID NO: 380262 - DNA, 2251 bp, Homo sapiens
cagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatactcctacttatggttatatcttatattctctattcaagtgacctgtcttttaaaaaggcagtgctgtcttacctcttgctagtgggttaaatgttttcaaaaattatagcagtagtagaagttttgtataaaatttgtccttatttgttaattgtatataaatgttaattatttgatacgaatgttatgcatttagtatgcacattgaagtctaaactgtagaagagtctaaaacaagttctctttttgcagattcacatactaatggtttaattctgtgctctgtttaaagtactattataactagagtagatctgaatgaggataaccctaaaatcatgaggaatggaagaatggaccttgaaactacctaggcttttatgcatggcacctctttataatgaagacactttttaaagtttttgtttttgtttcaattaccgctagatttttttttctctttttttaaaatccattttactggaaagttggccagcagagggagtagaaattattaaaattctagtgtttggattgggcccttctctaacagtacatactcattcccaaagcaatccaaaaacaaaatgtgaaccatttgggtttcaaatgttaagaacactaaatagcatgatttaaaaaatgaaaaatgctaacacccaagaaaagaagatattaagtgctttttaacaactcctagagtacaaaatgagtacatcataatgctggctcttctactaatgaaccatcgagtgatattgaataaattatttatcttctcagtttccttatctgtaaattacaatattagactaagtaagtttttccaactcttcactaccaattaccttaggcttttataatgctccgcctacttcagtcccatgtttcagaagcttttgtctattttttaaactcattgattaaataatgattaatgcattctccacattttaatattgcaaaggcccattggagtttctgaagtggctccacagaattgaaataatttcaaataactgtaaaggaactgaaaatcttcacagagatgaagtggggtttccattaggtgctttgaaatttgataacaaatcatcaacttccactggtcaatatatagattttgggtgtctgaggccccaagattagatgccactaatctccaaagattccctccaattatgaaatattttaatgtctacttttagagagcactagccagtatatgaccatgtgattaatttcttttcacactagataaaattacctggttcaaaagtggtttttgtttattaaatttggtaataaatatatataatacacagacaggatagtttttatgctgaagtttttggccagctttagtttgaggactccttgataagcttgctaaactttcagagtgccctgagacacttccagccatccctcctcctgccttcattggggcagacttgcattgcagtctgacagtaattttttttctgattgagaattatgtaaattcaatacaatgtcagtttttaaaagtcaaagttagatcaagagaatatttcagagttttggtttacacatcaagaaacagacacacatacctaggaaagatttacacaatagataatcatcttaatgtgaaagatatttgaagtattaattttaatatattaaatatgatttctgttatagtcttctgtatggaattttgtcacttaagatgagctgcaaataaataataccttcaatggaaaacaaaaaaaaaaaaaaaaaaaaaaaaaaactgtgtgtgtgggggcgcccctgggcccctagaaaagctcttttcaaaacacttcgcgtggggggcgcggcggccccaaggagggttcatcgtgacaccggtggcccaagaggcggtccccgaaggagacaccgcggcacaggaacacgagtgctcggggtatcctccacccaattaaaaagcgcgcggggggaaacccgacgcttcgctggacaaatctccaagg

SEQ ID NO: 380263 - DNA, 458 bp, Homo sapiens
tatgggaaagtggtgattttatctaagttaacgtttttataatgattactttgctatcttccttgaatctctttaataagaacttgtacaattaacacttacatttgaggcttagattcattgctttaaaaacagcaatagtttctattattaaattgcatttgaaagttatttccctttattttgaatgttatttggatcagtttaaacaagtgctctaaattgttccattaaataaattggttgaactagaaatggaggctttgtagataaaactgtcaccttggaattattggctgaatttaaatttcatgctaaaccatgtggttgtgaaaacgatgcatcaaatatgggtattgcaaataatctttattgcatgcatcatcttcaaagacttatctagaaaattaaataataaaaatgtgttttttgtttaaataaaaccatgcatttattgt

SEQ ID NO: 380264 - DNA, 227 bp, Homo sapiens
ttttagtagagacggggtttcatcatgttggccagactgatctcaaactcctgacctcaggtgatccacccacctcctcggcctcccaaagtgctgggattacaggtgtgaaccactgcgcctggccttaaaccaaaatcttgattgtgcttaaaatatttaagtaaaaaggtactttgctatgccagtgttccagtttgacagtgatcaattaaaaaatttttaat

SEQ ID NO: 380265 - DNA, 356 bp, Homo sapiens
gcatggtggcgtgggtctgtagtcacagctactcaggaggctgaggcaggagaatcgcttgaacccaggaggtagaggttgcagtgagctgagatcacactgcttcactccagcctgggtgacaaagagagactgcgtctcaaaaaaaaaaaaacaatgagaccgtcatcactagatcacggatttcaaattaaccattccacatattagtcgttcttcaaagaataagtttctctttatttagttaatatgcacaatagattacacatggtgtaacagaagtagaagtagattttttaaaaaattagaggagtcccagggtgctgtgcacctcttaagatctgttaataattcac

SEQ ID NO: 380266 - DNA, 339 bp, Homo sapiens
atctaattatatcctgatagggagaaggatagattcttactgagacaatgcaaataattacattgtcatgtaaaataaaagaactcaataaaggcatgttgtagaatatttggccattgctttgattagttttacagacaaggccaatcaatatgtgttgtattttctatataattaacatctttaaatttatctaatgatttaccagtttatatttcagctactgttgcagcgtaacaaaccaccccaaacttattgtggtaaaggaacaaccattttagatgctcacaagtttttctggtcaggaattttgtcaggacttagacaatccttttgctc

SEQ ID NO: 380267 - DNA, 2142 bp, Homo sapiens
tgttcccctgtgtttttttattttcctgacttattcaagcagagctagctcagagtacaggtctgtaacaagggcttattaggagatagatgaaaaagtgcaggtttgtatatgtaagttgtccattactatagatagatactattccaggcattggactttaactgcactgcctaaaagagcccaaagataaacttcacaataggctgatatgtggaatgggaggaggagataaagaacggggtttctgttttattcataagctcagtcttagcttcagtcttttctgagcatttgtttatttgtaagatggaagtcaaagtaagtgggaagtctgtaggtcagctctattttccatgcctgcccttgacttctcctcagctgttctctgcctgtgcaggtgaggcaggggaggtggttggtccagagagaactaaaagaagttgttttcttggactataggtccagctgcaaggcagggtgcctttcctatgtgttcctcttttcactaaaagactcaaaatgctttagcagctagatctggaactaactcttctggatggggtaggaacttccctgcccttcccttagggaagctcatgtttccaagtcagacagcagggggcattgggtgcctttcggacagaaggaagctgcctaagctagaaggcctgcctgctgtagtttatttcttttgccttgttcagtgaatttacccagagggtggctgagattgaggctttgggagccccaagaagctgcttggttttaatgtgctgccttatagctgagcctgttgtgctcagggcaagtagtaggatgttccccctgggatgtgcaaggttctctcaagcagacatgagcctccatcactcccaccactccctgcaactcagcctcctcttctcagcctgtgccttcctccagttctagtaaacactgccaaatgaatatagttctccgactcttctctgggggttcattggcagctgctgctttcttcattttttaaaatttatttgccacttggtgaaagccactgagatggttttttccagccttgggcaagttggagctttggaatctggagtgaatgaggtcatctggatttcattgtcttcttacgaagccagcagtaagcttgggcagtccactcacccacccctagggccatatctggggatgaagccacccccgacctatacataggaaatgattgatgtgcctggtcttatacccagtctgtgtctggtttctctaccctcagtgccctttggcttaggctcaggatgggtgggcctcccttccccagcagctgcctcagccctgatcaagggcagttatttggctcaaggtgagtagtggtttttaaaccctactcccacacactgctgagtctgtgttttcctttcttcctgaccaggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccgggtaagctagggttggaaatgaattcccaagggagtgacccttttaagagggctaaaaagttccagagtagtgacttcaagcagtaatcaggtgatcttggtcggatttcctatccactgtcctctgtccccatcagatccctgatatagccttggaagagacatcagcagaaaagggtggtatctacttttgtccattgccgtccatgtgtaatgctatcttcataaaggcaaaagctggagggtggaggagggaattgagaagaaataacaagtctcagtgtgacccttctatttttcctcttatgccaaaagaggcctagttcaggggttggcaaactggcagttggcctgctgctggtttttgtaaataaagtttcattggcttgcagccatacccattctgtgtattgtctgtggcggccttcacgctacaatgagttgaatagttgcaataaagaccatatagaccacaaaaaaaaa

SEQ ID NO: 380268 - DNA, 574 bp, Homo sapiens
gtccggctatacattatcaggtgagtgggagttggaggcattaaaattcttgagttcaagacagactgcgctgatgctcaactgctgaccactaaagtcataaaattcctaccagtttcccaaagagcttgagtgttgttcttggctttgttccagctctggttgaattacttttacaagtttaattgtctgtgggcttcttgtctttctgtcctaaactattgctgtgtatctccaaatgacttaagcctagaagtgaatgtgtgccccctgccccatgtcttcttttcttctttattcattttccttgtattttgtctttgtgtcgatcatattttttacgttgttaaaaactggaacttagtttgcctgagttctgttcatcctgttgtcaaatcaggtctcttcccctctcacagcttcgggttgtcatcccttggtatttagaggagaatatttagctgcttgtgactaaaagctggggagtgatgagtgatgctgcctttagttggtgtctgagtccagtctatttcagaattccgactttttaggatatagtgggaaattttttgta

SEQ ID NO: 380269 - DNA, 254 bp, Homo sapiens
ccagcagctctgagaaaaggggcaggaggaagaagtatctgggaataccattctctcactcttctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380270 - DNA, 4170 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380271 - DNA, 3764 bp, Homo sapiens
gaaagcgtggcagcgcaggcgcaagcgcagagagcggaggcggtggtggtggcggccgctggccagtgctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380272 - DNA, 4096 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380273 - DNA, 3937 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380274 - DNA, 4112 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380275 - DNA, 2859 bp, Homo sapiens
tcatcgagctcggccatggttagcagaggccagcacaagggagcgtccacagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380276 - DNA, 3654 bp, Homo sapiens
tgttcccctgtgtttttttattttcctgacttattcaagcagagctagctcagagtacaggtctgtaacaagggcttattaggagatagatgaaaaagtgcaggtttgtatatgtaagttgtccattactatagatagatactattccaggcattggactttaactgcactgcctaaaagagcccaaagataaacttcacaataggctgatatgtggaatgggaggaggagataaagaacggggtttctgttttattcataagctcagtcttagcttcagtcttttctgagcatttgtttatttgtaagatggaagtcaaagtaagtgggaagtctgtaggtcagctctattttccatgcctgcccttgacttctcctcagctgttctctgcctgtgcaggtgaggcaggggaggtggttggtccagagagaactaaaagaagttgttttcttggactataggtccagctgcaaggcagggtgcctttcctatgtgttcctcttttcactaaaagactcaaaatgctttagcagctagatctggaactaactcttctggatggggtaggaacttccctgcccttcccttagggaagctcatgtttccaagtcagacagcagggggcattgggtgcctttcggacagaaggaagctgcctaagctagaaggcctgcctgctgtagtttatttcttttgccttgttcagtgaatttacccagagggtggctgagattgaggctttgggagccccaagaagctgcttggttttaatgtgctgccttatagctgagcctgttgtgctcagggcaagtagtaggatgttccccctgggatgtgcaaggttctctcaagcagacatgagcctccatcactcccaccactccctgcaactcagcctcctcttctcagcctgtgccttcctccagttctagtaaacactgccaaatgaatatagttctccgactcttctctgggggttcattggcagctgctgctttcttcattttttaaaatttatttgccacttggtgaaagccactgagatggttttttccagccttgggcaagttggagctttggaatctggagtgaatgaggtcatctggatttcattgtcttcttacgaagccagcagtaagcttgggcagtccactcacccacccctagggccatatctggggatgaagccacccccgacctatacataggaaatgattgatgtgcctggtcttatacccagtctgtgtctggtttctctaccctcagtgccctttggcttaggctcaggatgggtgggcctcccttccccagcagctgcctcagccctgatcaagggcagttatttggctcaaggtgagtagtggtttttaaaccctactcccacacactgctgagtctgtgttttcctttcttcctgaccaggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380277 - DNA, 3205 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380278 - DNA, 3749 bp, Homo sapiens
cccatgatcgtatcatagtctgcctggcctttgagttctgcagccctctgtggagttagggcaaaaaggaagagtgagaatcgagttagggaatgaagagcaatcagctcttaagatgtatctggttaaccttatctttttttttttttttttttttttgagacctagaattaggaaggagttcaatcgctttctgttacaaggtttttggaccacaggagatgggaaaaacacagtttggaagactaaattatactgattgcccagaatagtctggttatccaaggcctctaaggaatgactgagacagctaagtctctcttcctttttattccttcttagctgtggggaacttcaaagagcctagccatctcttgatgaggttttttcagagagtggttttagaatttagaatggttctttgcaatcaggatcccattccttatgtttttcttgccctggtgaaagggtatttcaaattttcttctggtttcctctaaatttcagggacctgggacctgcatagatctagggtttttatggtttgaatacaaatggagaggagtctagaagttcaaggtgtgtctcactcttccctgcttcatttccaactcttccataggtccccctgtgtcatctgcagtgaacaaacccaaaacacttgagtcttaatgggaattatgcaataggcatttagagaaaggaagtcagaaggggccagtgaattttttcttgacataagctattgccttgcattctgttccagagagatgcagggctgaatgccctctcccaggccagcatttgtccattctccaaaagcattctgcaggccagtttgcttttagctcagccaatgccagggtttgatgattaacccatttgcccaggtgaggaaggcatctacttgggatgggtgggccccaggcctaagttttagtggtcctaagagtaaatgagtagaataagagatatagaggctacccctgaagcaaatttccttacatattcttgtctctgtgtaagctgaatgatcgatgtggtcttttacttggctccctctgctctgttttttggtcctaattttccagcagtgggggttaccaggcactactttcaatgtagtagactcagcagttctatatcatgcaaattgtaaatgtagagtagaatgtaattgtaacgtagaatgttagaaccaaagatcttagaagttattttctgccttgcccagatctcctgactgatttgaggatcttttctttgttcccattcagcttcacagggacaagggttgggggtggtatcagaggacagccccttagtctcccaagagcactttgatgcttgatcccattctctacattcccccagcccagtcatctaaggccagagctcttttctctgctcaggcattattgacaggataagtcctggcattcagacaggtctggtgaagtgaccaggtactctggcccagaagttctctgtcggctccccccgcaggctccaattcaggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380279 - DNA, 3225 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtga

SEQ ID NO: 380280 - DNA, 2658 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccgggtaagctagggttggaaatgaattcccaagggagtgacccttttaagagggctaaaaagttccagagtagtgacttcaagcagtaatcaggtgatcttggtcggatttcctatccactgtcctctgtccccatcagatccctgatatagccttggaagagacatcagcagaaaagggtggtatctacttttgtccattgccgtccatgtgtaatgctatcttcataaaggcaaaagctggagggtggaggagggaattgagaagaaataacaagtctcagtgtgacccttctatttttcctcttatgccaaaagaggcctagttcaggggttggcaaactggcagttggcctgctgctggtttttgtaaataaagtttcattggcttgcagccatacccattctgtgtattgtctgtggcggccttcacgctacaatgagttgaatagttgcaataaagaccatatagaccacaaaaaaaaa

SEQ ID NO: 380281 - DNA, 1836 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtaagattcatgaagggccagttgctgcaggcttccctgactcaaccccaaggctgcacctgaacttgttggtatggtgggaagagcttggactttcaagtcagtcatctggatttgaatcctggctttaccacttaccagctttgtgatcttggcagtcacttcacttctgatagcctcagttttttaatcga

SEQ ID NO: 380282 - DNA, 1491 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgtaagtgtagcagtaatatcattacagaactgt

SEQ ID NO: 380283 - DNA, 1353 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccacgttcttccctaacagctggtgaatctactctgggccttgtgttgcccgtgagggccggtccaccgttcgaacggctggcccacgtggtgcgagatttcaagttggccgcaaggggcgtccccattg

SEQ ID NO: 380284 - DNA, 1082 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380285 - DNA, 1027 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggtgagtgggagttggaggcattaaaattcttgagttcaagacagactgcgctgatgctcaactgctgaccactaaagtcataaaattcctaccagtttcccaaagagcttgagtgttgttcttggctttgttccagctctggttgaattacttttacaagtttaattgtctgtgggcttcttgtctttctgtcctaaactattgctgtgtatctccaaatgacttaagcctagaagtgaatgtgtgccccctgccccatgtcttcttttcttctttattcattttccttgtattttgtctttgtgtcgatcatattttttacgttgttaaaaactggaacttagtttgcctgagttctgttcatcctgttgtcaaatcaggtctcttcccctctcacagcttcgggttgtcatcccttggtatttagaggagaatatttagctgcttgtgactaaaagctggggagtgatgagtgatgctgcctttagttggtgtctgagtccagtctatttcagaattccgactttttaggatatagtgggaaattttttgta

SEQ ID NO: 380286 - DNA, 537 bp, Homo sapiens
acttaagggaagcttttattgggataggagatcagccttcttgatcaggtcccgggttcctcttcattgctgccccctcttcccaacctttttgggttccaggtgattaagaagaacaagcgggagcgggatgaagatagcttgcaccaaactgacctgtttgatagtcacatgctgtggttccttatgcatcacctgagacagagacgccatcaccgggtaagctagggttggaaatgaattcccaagggagtgacccttttaagagggctaaaaagttccagagtagtgacttcaagcagtaatcaggtgatcttggtcggatttcctatccactgtcctctgtccccatcagatccctgatatagccttggaagagacatcagcagaaaagggtggtatctacttttgtccattgccgtccatgtgtaatgctatcttcataaaggcaaaagctggagggtggaggagggaattgagaagaaataacaagtctcagtgtgacccttctatttttcctcttatgccaaaagaggc

SEQ ID NO: 380287 - DNA, 964 bp, Homo sapiens
cgagggggacataggctaggtcgaggctggtggctggggggacaggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttaaagtttcgttgggttcccccccccccccaccctcccaaaacccttttccggggggtctagccctaacccatttttcgttcccttttctttgttcc

SEQ ID NO: 380288 - DNA, 4011 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380289 - DNA, 3978 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380290 - DNA, 4140 bp, Homo sapiens
ttagaacggtcccatttggtccctgttagttggaaagcatctggtggcttgaatttctgactcatgattgttactggagtctctgtaaacaaaccggcactagcgctatcacattctctccgggatttccccccctgctctgtggcttcttgttgagaggttgtttggttatggtttagcgttgaaaagattcaggttatccttttaaatgactttacgttttagtggagctgggagattacttgcctggcttctaatcttcatgttggttcattttatttccatatgtgtgtgggttatttgttcagtaattagaattagataaagtattctgcttttaagtagttttgagaaggcctaaaaatactaaagtgtattcataaatatttttattatgttcagtagaagacacacctttgccatgtaaattttaacttttctcagtccttcagtgaatctacagacctattttctcaggagctcagcctggccttacttcagtgataaaaggaggaaaggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380291 - DNA, 4061 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctagaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380292 - DNA, 2552 bp, Homo sapiens
gtcagtatctgctccttattgcaggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctccatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380293 - DNA, 3122 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaccccagcaaccccatcccagaatcctattttcctgggaagtccttaaagcccctaaccatcccacactcttcactttcctttccaccttattcattcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggctacagcaaacatcattcaagatgtccagcaaagggagcagcacagatggcagaacagacttagctaatggaagcctgtttagcagtccagaggagatgtttggagctgaaaaggggagggagacatcctcaggcattgaagtggaggcctcagacctgagtttgagcttgactggggatgatggtggcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380294 - DNA, 2118 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 380295 - DNA, 1514 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagtataagcacaggctcttgaaccaaactgcctgagttcaaatcctagcccttctgcttactagctcagtgatcttggccaagttattttacctttgtcttcagtttatctgtaaaatgggactaataacacatagggttatgaggattaagtaacaatagaagctaagcagttagaactgtgactggtacttaataaacatttgataaatgttaaaaaaaaaa

SEQ ID NO: 380296 - DNA, 1332 bp, Homo sapiens
gaaagcgtggcagcgcaggcgcaagcgcagagagcggaggcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagggccacctctgggaaggcttcaccaaggaagtataattggagctctgtcttgatgttcaaataagagctgcagagagggtgctatcgagcagcacataatcacttaattacatattgctttgtattcttcttcga

SEQ ID NO: 380297 - DNA, 812 bp, Homo sapiens
  misc_feature (5)..(6): n is a, c, g, or t
  misc_feature (13)..(13): n is a, c, g, or t
cgacnnacgcgtngcgacccacgcgtcgcccacgcgtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380298 - DNA, 2592 bp, Homo sapiens
acattgcagccttctgcaaggatggggtggtactgtccttctcacttctcattctcttccattttaaaatgataaacctgggtcagaggatatttaggaagaggcattgtcattaagtccaagacaagatggtcagatttgttatcctagtgggttacaatccaaaatactctggagcatgctgagattaaggtggttgccaagggaacagaaaacagccatgagtaaataaatcaagactttaaaggatttagatcgggtctatggccagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380299 - DNA, 765 bp, Homo sapiens
ggggttgcgacgcagagtttaccatatttctccagggttgctccggccgcagaagttggcaaggttgtgtgtaaggtcgggtggggtggggtcagctctcccgattaatgcagctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctgtgagtgtggcatgggaggaaagaacttgggggagagacggggggcctttcggcgtgcaggcggggcctcagtcaggggtatagctggggagagtgaggaggctgcccagtcacagggccgggctgagattggccaaggggactttgatgatctgtctttgcagatgtcagtgcagctgcctgtggaaaagacttgtgggtggggtctcttgcaagtaggacttgtctccttccccagggtcagttccaccccggcctcgagggtacggaagacagaggaggtggccctgagaccccactctgcagataggttgactgaggctggaagtgaagagaggccttcggggaggtccagtggaatattcagccggcttccctgatggggttggggagaatggatgaggcaggccttagggccctgcaggagcccaagttttggtgggggtcgtgggagtggtggcagtagacagtgcatctacaggagaa

SEQ ID NO: 380300 - DNA, 275 bp, Homo sapiens
cctcaggaggtgcggaagttcctgtcacctaagtgctcaagcagaggccaggtgtccatatgctagaaatggagaaaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380301 - DNA, 4523 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380302 - DNA, 4550 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380303 - DNA, 4181 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380304 - DNA, 4023 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagggcggtgtggggcttctgccacccgcggccagccgcgatgcggaaggggattctgacggagtcgtggtcacaccagctggccctgcgcagccccatgggaaataggcctggaattcctgtcgggaggaggctgggggaaggggagccagcagggattccagagttcctgccataggccggcctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggaacagggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380305 - DNA, 4787 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaaaaaaacacgcaaggaaacaacaacacactacttcactaatcacccctgtgtttggccggcatctcgccctagcaaacatcgtctcttacaccacttctctatgacgccgcgcgcccactccgtcggcaccctgggcacagcgcgtgcctgaagccactccgttcagcacccggggcggactcccccgataaaaacgccggggcacgcacgtatagcaactcgccgcgaccgcgccactcggacttcacgcggcagcgctgttta

SEQ ID NO: 380306 - DNA, 3120 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380307 - DNA, 3164 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380308 - DNA, 2848 bp, Homo sapiens
  misc_feature (3)..(3): n is a, c, g, or t
aanggctaggtagaggctgggtttaatcggccgaggcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380309 - DNA, 4378 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacataccgccaggggtttgcccaagtcacggccgctctgggtcgccagggttgtct

SEQ ID NO: 380310 - DNA, 4208 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380311 - DNA, 4264 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccgaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380312 - DNA, 3494 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttatgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380313 - DNA, 2325 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380314 - DNA, 3163 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagggcggtgtggggcttctgccacccgcggccagccgcgatgcggaaggggattctgacggagtcgtggtcacaccagctggccctgcgcagccccatgggaaataggcctggaattcctgtcgggaggaggctgggggaaggggagccagcagggattccagagttcctgccataggccggcctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380315 - DNA, 1857 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380316 - DNA, 3276 bp, Homo sapiens
gacccctctctctccaccccccacccccgcccccgcttctgtctccctagggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380317 - DNA, 3340 bp, Homo sapiens
gactggaaggagtgtaggccgtgcttaaaaggcagtggaggaagaggaacaccaattcccagcaggggaacttgagcttgaacaaaacggggcgaaaggtggaggttgtgggagggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380318 - DNA, 3416 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagagatggcaggaaagggacacagccggcgctgatgctgggaggcctccagggatggagagtggcctggctggcaacggcacagggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380319 - DNA, 2337 bp, Homo sapiens
aggctcattgtctctagggctttctgtcttgctgtaacgtctctccagccagctgcagctcctgctgacttatcccaccccagcgcaggtcatccaacggtgacttatggccccggcctcctggctcgatgaggatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatctttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagaagacccactcccggcccgccacccactcgtgccccgagtgcgagcgctgcttccgtcaccaggtgggcctccgcatccaccagcgcgcgcacgcccgggaccgccagggctcccgcgccggcctgcacgagctgattcaggacgcggcggcgcgccgggcctgtcgcctgcagccggggccgccgcgggggcgccccgagtgggcctggctggggctctgccagggctggtggggccagcccggggcccgggccgcggtctccggccccgaggggccgggcgagccgcgccagttcatctgcaacgagtgtggcaagagcttcacctggtggtcgtcgctgaacatccaccagcgcatccacactggcgagcgcccctatgcgtgccccgagtgcggccgccgcttcagccagaagcccaacttgacgcggcacctgcgcaaccacacaggcgagcgcccgcacccctgcccgcactgtggccgcggcttccgccagaagcagcacctgctcaagcacctgcgcacgcacctgcccggcgcccaggctgcgccctgccccagctgcggtaagagctgccgcagccgcgccgcgctgcgcgcccaccagcgcgcccacgctgtcgctgagcccgccgttccggccggggaaccgggcgaccagccgcaggccgaggccatcccgggcttggccgcgaggccgcggagctcccaacggtccccgggggcccgggacacactgtggggccggggacaagcgggcctcgctgggcctggcgagccgcgccagttcatctgcaacgagtgcggcaagagcttctcgtggtggtcggcgctcaccatccaccagcgcatccacacgggtgagcggccctacccgtgccccgagtgcggccgccgcttcagccagaagcccaacctgacgcggcaccggcgcaaccacacaggcgagcggccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggagtaaa

SEQ ID NO: 380320 - DNA, 3333 bp, Homo sapiens
ggggttgcgacgcagagtttaccatatttctccagggttgctccggccgcagaagttggcaaggttgtgtgtaaggtcgggtggggtggggtcagctctcccgattaatgcagctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagccgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380321 - DNA, 1264 bp, Homo sapiens
tggccagggccgggagcccggtgcccaagtcgccctcggggtggcagttcccgttaaccttagccacaaagtcaaagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatctttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggagtaaa

SEQ ID NO: 380322 - DNA, 2190 bp, Homo sapiens
  misc_feature (12)..(12): n is a, c, g, or t
ggtgtctaaagnttccccttttaaggtttcaacaaatttcattgcactttcctttcaataaagttgttgcattcccagcttgctcagacgtctgagcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380323 - DNA, 1320 bp, Homo sapiens
aggctcattgtctctagggctttctgtcttgctgtaacgtctctccagccagctgcagctcctgctgacttatcccaccccagcgcaggtcatccaacggtgacttatggccccggcctcctggctcgatgaggatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatctttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggagtaaa

SEQ ID NO: 380324 - DNA, 429 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgag

SEQ ID NO: 380325 - DNA, 2280 bp, Homo sapiens
tggccagggccgggagcccggtgcccaagtcgccctcggggtggcagttcccgttaaccttagccacaaagtcaaagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatctttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagaagacccactcccggcccgccacccactcgtgccccgagtgcgagcgctgcttccgtcaccaggtgggcctccgcatccaccagcgcgcgcacgcccgggaccgccagggctcccgcgccggcctgcacgagctgattcaggacgcggcggcgcgccgggcctgtcgcctgcagccggggccgccgcgggggcgccccgagtgggcctggctggggctctgccagggctggtggggccagcccggggcccgggccgcggtctccggccccgaggggccgggcgagccgcgccagttcatctgcaacgagtgtggcaagagcttcacctggtggtcgtcgctgaacatccaccagcgcatccacactggcgagcgcccctatgcgtgccccgagtgcggccgccgcttcagccagaagcccaacttgacgcggcacctgcgcaaccacacaggcgagcgcccgcacccctgcccgcactgtggccgcggcttccgccagaagcagcacctgctcaagcacctgcgcacgcacctgcccggcgcccaggctgcgccctgccccagctgcggtaagagctgccgcagccgcgccgcgctgcgcgcccaccagcgcgcccacgctgtcgctgagcccgccgttccggccggggaaccgggcgaccagccgcaggccgaggccatcccgggcttggccgcgaggccgcggagctcccaacggtccccgggggcccgggacacactgtggggccggggacaagcgggcctcgctgggcctggcgagccgcgccagttcatctgcaacgagtgcggcaagagcttctcgtggtggtcggcgctcaccatccaccagcgcatccacacgggtgagcggccctacccgtgccccgagtgcggccgccgcttcagccagaagcccaacctgacgcggcaccggcgcaaccacacaggcgagcggccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggagtaaa

SEQ ID NO: 380326 - DNA, 433 bp, Homo sapiens
taaagtggggctcaataaccctgctccgcccctttctcagggctgttgtgaggacaatgggaaacaatttaagaggaacacagtgtcctgggaagaggatcctttggagaagcagcatgaagggagctgggtttgggggtgttggctgggcactgagggtgctgctcagccttgggccaggctttgctgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380327 - DNA, 5251 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagggcggtgtggggcttctgccacccgcggccagccgcgatgcggaaggggattctgacggagtcgtggtcacaccagctggccctgcgcagccccatgggaaataggcctggaattcctgtcgggaggaggctgggggaaggggagccagcagggattccagagttcctgccataggccggcctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380328 - DNA, 4614 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380329 - DNA, 3250 bp, Homo sapiens
  misc_feature (3)..(3): n is a, c, g, or t
aanggctaggtagaggctgggtttaatcggccgaggcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggaacagggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380330 - DNA, 2967 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380331 - DNA, 3695 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagggcggtgtggggcttctgccacccgcggccagccgcgatgcggaaggggattctgacggagtcgtggtcacaccagctggccctgcgcagccccatgggaaataggcctggaattcctgtcgggaggaggctgggggaaggggagccagcagggattccagagttcctgccataggccggcctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380332 - DNA, 2796 bp, Homo sapiens
ggttgaactcaccccaaaatcctgggtgaaggaatccacagcatgctgacgctaggacatcctgtctagatggacccagtgctgaaatgactccattgtcccgctagatctgtatcgacgatgtgccgactgactagtgcactacactcgtagtgctatgtggatctgtggattctaaatcacacggtatcgcggccatttgtcacgttgaacgcctggctctgtaggatgatagcgcctggacagtcatcttctgacgatgcatcacactttcttaggatcgtgtcaacacagtcccaggctcctagtgactagtcgtgtgcaatccacctagaacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380333 - DNA, 4469 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380334 - DNA, 4140 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcacagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380335 - DNA, 3909 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcaggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380336 - DNA, 3420 bp, Homo sapiens
  misc_feature (5)..(6): n is a, c, g, or t
  misc_feature (13)..(13): n is a, c, g, or t
cgacnnacgcgtngcgacccacgcgtcgcccacgcgttgtgaactcgaacctgccgctgtcgccgcggcggggcggggagcgagagtgggccgcggaggccggccttcgggctccatggacgggcgccgcgtccctgcacagcccgccgcagaggtacggccggggcaggggcgcggggccaccgcgggcccgcggggggccgctccacctgcggggcgcgtgaccgtgagtgtgcgcgaccgtgtgtgagtgcgcggggggggacgctgctggatctgcgggggtgggggagcgcacctgcgcacaggctccgcgagctgcgccgtgcgtgggacccgaaatggctcactcgcaagaacgggacccgtgtgcccgggagcgtggacggaggacacgcatcagtacaaaagggcggtgtggggcttctgccacccgcggccagccgcgatgcggaaggggattctgacggagtcgtggtcacaccagctggccctgcgcagccccatgggaaataggcctggaattcctgtcgggaggaggctgggggaaggggagccagcagggattccagagttcctgccataggccggcctttggccatcagggaaagcccagactctggccacagaatggagaattcgttccgtgaccttaccagggaagaaagtgaccccgaaagacagcagtgtgcttccttgttgaaggggcacattcatttattaatccaatgtccattaaggtcactctgccaggcaggatgtggggcttatggctggtgcgtgtggctttgtggggggaggggttgtggctggtgaggacacaaagctgactgccctagaggagctcagagcctcacttctgttttctcttccctccccacaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380337 - DNA, 1483 bp, Homo sapiens
ttttttttattgtatttatttggttgtgcatttgttctaccactctcttttatcggtcttttttgtgttctgactgttgtaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaa

SEQ ID NO: 380338 - DNA, 3505 bp, Homo sapiens
ggggttgcgacgcagagtttaccatatttctccagggttgctccggccgcagaagttggcaaggttgtgtgtaaggtcgggtggggtggggtcagctctcccgattaatgcagctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380339 - DNA, 3398 bp, Homo sapiens
cgcatggtcgccgctccggcccgggcgggcgcagcgctggcagccccgttttccgccagccgggctgccggagagttagacctcccagcctcacggggctgctgtgcggctgcgacgacgccggcgactgcggcgctgcagcggagacggaaggctcgggaggcggcgccatggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgcttgttcctgcctctgtgccttcccctatactgctcggacatgtcccctttcctctcctctacccagctaagcccttctgatccacggggcccggcttcccaaaccacccagcccacattcctccttcctgctccgaacaggtcccgtgtgagcccctgcccccgaattgcgtgctgtcccatggacgctccagtctcttccgtgtgtgtcttgagtccctaactagacagttagctccctgagggcaagggactgtcatttcctcttgagtcctaccagggtctagcacaggactgggctcctaactctcaggaaacacttgtcggctgactggtgcctcaagcgctggagcttgtcggtggccggtaatgggcagtgcacgtggggagagggtatgtgagttaactcaagggtgccttttcttgggctgtgggctggctcccctgggtcaaaagtggatgtcggaggcctcaggctcttacctccttggggcagtgggagcatcagggacccccacccccaccccggctctgcaggagtgcacggaagtggtcgtccagcctggatatttctacaggttgctgactcctgcgggagctgactgagtggaataaatgttctctcaacataaaaaaaagtaa

SEQ ID NO: 380340 - DNA, 1982 bp, Homo sapiens
ggggttgcgacgcagagtttaccatatttctccagggttgctccggccgcagaagttggcaaggttgtgtgtaaggtcgggtggggtggggtcagctctcccgattaatgcagctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgagga

SEQ ID NO: 380341 - DNA, 2358 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagagatggcaggaaagggacacagccggcgctgatgctgggaggcctccagggatggagagtggcctggctggcaacggcacaggagctgggctggtgatgaaggtcaagcaggagaagccggagcggctgctgcagacgctggcgccgcaggccatgcttgtggagaaggacaaggagaacatctttcagcagcaccggggcctcccgccacgccagaccatggggcggcctcgagccctggggggacaggaggagtctgggagtccaaggtgggcccctcccactgagcaggatgcggggctggcaggccgggctcccgggtcagcctccggccccctgagcccctcgctttcctccggcgagggtcactttgtatgcctggactgcgggaagaggttcagctggtggtcgtccctgaagatccaccagcgcacccacaccggggagaagccgtacctctgcggcaagtgcggcaagagcttcagccagaagccgaacctggcgcgccaccagcggcaccacacgggcgagcgacccttctgctgccccgagtgcgcgcggcgcttcagccagaagcagcacctgctcaagcaccagaagacccactcccggcccgccacccactcgtgccccgagtgcgagcgctgcttccgtcaccaggtgggcctccgcatccaccagcgcgcgcacgcccgggaccgccagggctcccgcgccggcctgcacgagctgattcaggacgcggcggcgcgccgggcctgtcgcctgcagccggggccgccgcgggggcgccccgagtgggcctggctggggctctgccagggctggtggggccagcccggggcccgggccgcggtctccggccccgaggggccgggcgagccgcgccagttcatctgcaacgagtgtggcaagagcttcacctggtggtcgtcgctgaacatccaccagcgcatccacactggcgagcgcccctatgcgtgccccgagtgcggccgccgcttcagccagaagcccaacttgacgcggcacctgcgcaaccacacaggcgagcgcccgcacccctgcccgcactgtggccgcggcttccgccagaagcagcacctgctcaagcacctgcgcacgcacctgcccggcgcccaggctgcgccctgccccagctgcggtaagagctgccgcagccgcgccgcgctgcgcgcccaccagcgcgcccacgctgtcgctgagcccgccgttccggccggggaaccgggcgaccagccgcaggccgaggccatcccgggcttggccgcgaggccgcggagctcccaacggtccccgggggcccgggacacactgtggggccggggacaagcgggcctcgctgggcctggcgagccgcgccagttcatctgcaacgagtgcggcaagagcttctcgtggtggtcggcgctcaccatccaccagcgcatccacacgggtgagcggccctacccgtgccccgagtgcggccgccgcttcagccagaagcccaacctgacgcggcaccggcgcaaccacacaggcgagcggccctacctgtgtcccgcctgcggccgcggcttcagccagaagcagcacctgctcaagcaccagcgcgtgcaccgcgcggcccctgcgtgcagccccaaggaggaggcgcgctagtggactggacctcagcggacccgtggtggtgcgggggatgtttgcggggtgtgtgtggggagtgggggtggccaggattgctggctcttagaaccccttagagcgggaccggtggattccttaaggctctgaagggctgagaacagttctagaagcgtcccaaagggtgctgggaaaggtcccagcgtgggttgagggaggagggaagatccgagttcctcaccgcgggccgggatgtgaccaccctcttcagaggttggaccccaggcttcaagcaccgagtgaggggtctgttggggacgctgggagagtctctggtgtgaagtggcttaggtctggactggtcagctgtggcaccagccggtcctgcccacgcttcaggatggccgggggctgcccctgtgggagagttgccaagactcggcgataccaaggatggaagccagaggctgtggcgagggagagccaagcatattcccagcaccagggccactgctggcacgtcgtagacatccaataaatatttttggaaggagtaaa

SEQ ID NO: 380342 - DNA, 3046 bp, Homo sapiens
ggggttgcgacgcagagtttaccatatttctccagggttgctccggccgcagaagttggcaaggttgtgtgtaaggtcgggtggggtggggtcagctctcccgattaatgcagctatttgataagagcaacgtcgcgggacgcttgccgtctttatgggggcggggagaaggggcgcgggtgtcgctgcgggagagttaccgtatttgcgttgagcagcgcagactgtagagcaaagagctgcggccggagaccggaggagcaggggctcagctgggctggactggtgattgcagctggaagtgcccatgaccgagctggcgtcctccgggggcgggtcccctgcgggggacggggaggagggtctgggggacgagcgaggcctggtcatccaccaccctgcagaggagcagccctaccgctgcccgctgtgcggccagaccttctcgcagcagcccagcctggtgcggcaccagaaggcgcacgccggagcgggccgcgcggctgccttcgtgtgtcccgagtgcggcaaggccttcagcgtcaagcacaacctcgaggtgcaccagcgcacgcacaccggggagcggcccttcccctgccccgagtgcggccgctgcttcagcctcaagcagaacctgctcacgcaccagcgcatccacagcggcgagaagccgcaccagtgcgcgcagtgcggccgctgcttccgcgagccgcgcttcctgctcaaccaccagcgcacccacgcgcgcatgcccgcgccgcacccgcgccgccccggcgtcttcggggagcggcggccctacttctgcccccgctgcggcaagagcttcgcgcgcgagggctcgctcaagacccatcagcgcagccacggccacgggcccgagggccaggcggcccacttaggacgcgtgctatgatgcgcccggggcctgctgccgacggctgcttcccgccccgcacgtgcgtccccgacccctggagatggccctgggccgcagctccctctctagatgggatcccgggagaggggcagcgctggcttgggctcttgaaggtgtgggccgccgccaggctccggccgcccgctcgcgttcctccctcgggaccctctggctggctgcgcacagctgcttccggctcctgccatggttctccttctctggcccatccggcctagagcagttgcagagtgggcaggatcttaagacccgataggtgcagaacccatctggacacggagaccaggaatggagttccatggaggcctggctggcactgcacccgggcatgaggacacatccagtaagaagacctgcctcaagaggtgcactgcggtgaccagtggaggtgactggttggagcctggaattggaagcagattccaagctctggtggacaaactctccaggcctggtgggaatcacagctggggcagacctcatcctggctgcctggccacaggcccccactctctgccactggtggtaggacgatgcctgtgtggagagctggcttctctgctcccgcctggtccaccacttggctagagttcagagacaggaagtgattggtctaagctaacacagcaagttggtggcagacctggttctagaggcaaaaccttcttccagatgtgaatgaaacctgcaggcttcattttcctttctgagcagtgcttcttagctctttggagacacgaagcccttggaaaatctgatgaaggttacggaccttccctaggaaaacagataactgacgtagactcaaaaaccccaagcaatttcaggagccactggactccctgaatgaaacccatccctggactccaggctaagaacctcagccctggggacttcacctgctgccctttccttacctgtcacacattgagccccgagtcaaggccactgtacaagtagtgcccctccctccccctggccaagcctccttcccttgttcaggaataaagaattccgaggagccctttttagtcattcccttctcccagacctaacgaatggtgcgtcaggtttctggagcctcatttcccttccccagacattggcagaggtcccttgggctagattttctcttctggttttgtttcttgttctgcctgactggccgctggcttccacaaaggagccctttgctcctggcctgggctctgatttcactgtgtggtctcaggggaagctggactgctgtggacgctggtgggagcttgagtctggtctgagtctgccccaggaagaaagaatcctgcttccaccaaccaagcccagtcagcggttcctcccaactggccaagtgttcagcccagtgggctggggaggaagaggatgagggcctcgctcctggtgcctgtggctctgggcagggtgagaggtcggtggaggatctttctgtgtgttctctgagtatgcagcagtgcagttgaagggaacagggcccaggcaggcagcaggacgaggactcctcccatcttcacacctgaaccagtcagcctggaagctacaagttctcacctgcctccccagaatgaacatcagaaaaggcaaaactgaccagggctgggatgggtttgggtcagcgtggttggagggcagcctgtggatccctgcactggagtcttgctgtcttcgatgcaggttggatcatacattgttacctcctactgtatgcctcaccctggaatagcagaatgctcagggggagatccgagaacgagaaggtgctcccagccccaggagcttccagtctggctctgatccttggccgacctagaggaaacctccacacacgccccttttgtgctaatggtgcagtttgtgtccccctctgcccatcactgtgctgtgtgtctgctctgtgcttccttttgtcgattgtccttctctcctaccgtagcttgattccgggcgttccaccccgcctccctctgtcgaggccgtgcctcccatgttggtcgggccttcggttgcacaggccgggggctcgccgggaggcccaggccccgcgggggtgtttctgtctcggggtgc

SEQ ID NO: 380343 - DNA, 1991 bp, Homo sapiens
gaacccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccagggtagagtctggcctttgctgtgctcccaaaccacgccacaacaggggtgcacgggcgtccccatcccggcggaaggaaatggccctttctcatatcctggggtcttccctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccctccccttctattgccccagtaatctccagcaccccgagggaggcagagccggtgatcaggccccgagggcagcaggctgtgggtgttccttggattcagggagagcattccttcctgcaatgtcctaatttgtgtgggtggaagagggcaggcgggcagaatgggggcacagtctgggcaggcggtggtctggcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcagcgggactcagaagagacgatgtgaagtgggagggccctgcatggctgccaccgatcttctggcctccagagtcccagacctgggaggatccgggtgaggacagcagtcagtggccatctgtgccagccaggaggccatcgtggccactgtaagccttccggtggtgtctgggtcacaccgcgtgcagcgctgcctgctgcctgatgtgcgtgttcgcatgccctttaatgcgcagtctgtgtgcaccaactggttgctgcactctgtggagtcagtggg

SEQ ID NO: 380344 - DNA, 475 bp, Homo sapiens
tttggtggagatggggttgcaccatgttgctcaggctggttttgaactcctgagcttaggagatccacctccctcagccttccaaagtgctgggattacaggtgtgatccacggagcccggccatacttgtgtatcattaataagaaggtgaaaatagtagaggttctagttttctcagatgcaaaataagatctcttttactatcatgtatgaaaaattttattttgtactcttatttcatgctcccatttgggaactgtattattttccactattgctgtaacaaatcaccacaaactagtggcttaaaacaacatcaatttattatcttacagttcaggaggtcaaattcttagttcaaggctgggaccgcaggcgtacgaccacacccggcctgatacatatgtattttagaaaacatgaaaaatattaaaaagtaggccaggcgtggtggcttatgcctgtgatcccaga

SEQ ID NO: 380345 - DNA, 351 bp, Homo sapiens
  misc_feature (24)..(24): n is a, c, g, or t
ggcaagaaggcgtcggcggcgcantgcggatccagaaggacataaacggcagcttgttcctccaggctggtgggcttggtgccctcggccttgggatgcttatcacagtcctttgggaccagaacactggatatcagtgcagcctctgggccagcttcagaggctgttagagcatcattgctgctgtggctgatgcttcctttcctcagtaagtcacaaaagtcgtgttggccatccaggttaccgagtgacttaatttccagaaaatttaatattgagtcattattgtatgcattttcactgttgccattttgtatcctcgtaggtagtctatgaagtaccactgggtca

SEQ ID NO: 380346 - DNA, 413 bp, Homo sapiens
gagctcggtccccacttatgcggggcttctcgtttggggaacaaaaaaataaagttaagaaaaacattttgcatagattcttctaaaatacacacacacatatacacacactcatacttaggattgttctttttgtaatagtaataccaacagacaaaactccaaaaaagaaaattctaatagtattctccagatttcatcatccacctactgccccttgtggagagggaagatctcatatccttcctgatgtcaacatccacctatatgctaatgcttcccacatccatctcaagcccccatctgcgatgtcagtattgtatacgtcattgcctgctgggtctccactgcccttcctcaaaatcaacttaggtaaaatgaaattctcttcttccctcccttctccctcaccc

SEQ ID NO: 380347 - DNA, 878 bp, Homo sapiens
gcaggaaattaaataatagattactttctattagtaaagaccaatatagtggctataattatagaacactaaaatttttgtcgggcatgttagctcacgtctataatcccagcactttggtaggccaaggcaggagtatcgctgagcccatgagtttgagaccagcctgggcaacatagcaagaccctgtctctacaaaaaattaaaaagttagccacatgcagtagtgcatacctctggtcccagctagttgggaggctaaggcaggaggattccttgagcccaggagttcaagtctgcagtgagctgtgactgtgccactgcattccagcctgggcaacagagtgagactctgtctcaaaaaaaaaaaaaaagaaaaagaaaaaaaaatacatatatatatacacacacacacacatatatgtagtcttaaattatatgtggggttaaaacaagtcagcaagttttccagcttatattaccttaatatcttctcgtttggggaacaaaaaaataaagttaagaaaaacattttgcatagattcttctaaaatacacacacacatatacacacactcatacttaggattgttctttttgtaatagtaataccaacagacaaaactccaaaaaagaaaattctaatagtattctccagatttcatcatccacctactgccccttgtggagagggaagatctcatatccttcctgatgtcaacatccacctatatgctaatgcttcccacatccatctcaagcccccatctgcgatgtcagtattgtatacgtcattgcctgctgggtctccactgcccttcctcaaaatcaacttaggtaaaatgaaattctcttcttccctcccttctccctcaccc

SEQ ID NO: 380348 - DNA, 1049 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagaggacacaaaccacagtcaaaaaaggtcttcctgagttctgaaggtcaagcaattagaattttctcaggcttgtagaagagtggaattctggaaaccagtcttcgcctcaggggagcatctgttggaagttcttagggatgctcaggcatatggcctcagaaacatgggctattgagacagagaaaaagacaactctggaaggagagagcctggccttacagaagacatctgaactatcaatcaacagaaatctcacgtatagttgaagaatcagaaatctgagcgtaggaagaagtgggttagccctggagaaaggaaaaggaggatcatggttctctgcaaagagctggaagctaaaaagcaggctgtgtttacttaccaaccaggactcagtgggatctttgccagcttccaatatggccttaaaagtatatgaaatccaagaaatatttctgcaaagcaagagatcttcactgctttattttccaccacctgaatccttgcagtgagtgtagtgtgtatctaatcaatctattaaaaaatacttcaaaagttctaaaa

SEQ ID NO: 380349 - DNA, 646 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctgggatgcctcagcactaatgatcatgatcagagaccccgagttctctcgtgctgctacgcttcgcaacacatagcacaaatggaatatgtgttgacacacccctctgaagttaagatctttgatattaagaccctgacttttttccctttcattcttccgaaccctctgtgtactttgagcagcactgtggttgattaataaatcatcaaatgtgaaaggaagaaagcgaccttcctgtgtggaaaagcagggtatcttgcgaggctgtatgagagagtattcggtagaatcaggagctgtggacgcattcctgattttgtttt

SEQ ID NO: 380350 - DNA, 502 bp, Homo sapiens
acagtgtaggatccagccaacaggaccaggacagcactggctacactggcttatcgattacatcccacaatagaaaggatgctcaggcatatggcctcagaaacatgggctattgagacagagaaaaagacaactctggaaggagagagcctggccttacagaagacatctgaactatcaatcaacagaaatctcacgtatagttgaagaatcagaaatctgagcgtaggaagaagtgggttagccctggagaaaggaaaaggaggatcatggttctctgcaaagagctggaagctaaaaagcaggctgtgtttacttaccaaccaggactcagtgggatctttgccagcttccaatatggccttaaaagtatatgaaatccaagaaatatttctgcaaagcaagagatcttcactgctttattttccaccacctgaatccttgcagtgagtgtagtgtgtatctaatcaatctattaaaaaatacttcaaaagttctaaaa

SEQ ID NO: 380351 - DNA, 782 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagaatcagaaatctgagcgtaggaagaagtgggttagccctggagaaaggaaaaggaggatcatggttctctgcaaagagctggaagctaaaaagcaggctgtgtttacttaccaaccaggactcagtgggatctttgccagcttccaatatggccttaaaagtatatgaaatccaagaaatatttctgcaaagcaagagatcttcactgctttattttccaccacctgaatccttgcagtgagtgtagtgtgtatctaatcaatctattaaaaaatacttcaaaagttctaaaa

SEQ ID NO: 380352 - DNA, 668 bp, Homo sapiens
actgaagtaactgaggcacccatgctggcctgcaccagacagtgtgtgtgagacccttgaacacagtggaaatgcaggcatcactgaggcacccagcctcaggctgaggacagagtgcctgtgctgtaattagatgtgactcctccacagccaagagggcctacactctcagtgacgattcttccatgacattcaggcactttccccaggtacagccatggcagaagatggctgggcacaagggaccagctgcacgctgctcctggagtcagctctccaggacaggcctcaaccttgggcctcttcagaagcactgctcctatttcttgccagccgatctcagcccaagccacccaagtctgcacccccctgagtacagtggagatattacattaactttgaaataaaaggagagactctaggtctcactgctcccttccagaagcttcttttgcctcttgcaaacatgggtggctttgggaggattgccagcacacttcatataccagaagcacctcagccctgaggtcttggggacatagataggttcttcatctcacgtgatggggactgagctctttttggtgggtaaagtggattgaaataaaggaggagggctgacaggaatttgagactagcctgggcaacaaagcaagaccgcatctcta

SEQ ID NO: 380353 - DNA, 646 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagaggtcagtaaattgtcaagtttgtatatctagcaaatagcagagccaaaattcctgtcactcaaactcaagatttcctcatctataaaatgtagttgttccacatggccagatgcaaagtgtcatttagctataagagtctaatgaatctaggtcccaa

SEQ ID NO: 380354 - DNA, 730 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggattggtggagtcagtcccaagcaggacccgcgttggagaggggattactgatgttacaagcgcacattacttcaatcccctagatgcctcagcactaatgatcatgatcagagaccccgagttctctcgtgctgctacgcttcgcaacacatagcacaaatggaatatgtgttgacacacccctctgaagttaagatctttgatattaagaccctgacttttttccctttcattcttccgaaccctctgtgtactttgagcagcactgtggttgattaataaatcatcaaatgtgaaaggaagaaagcgaccttcctgtgtggaaaagcagggtatcttgcgaggctgtatgagagagtattcggtagaatcaggagctgtggacgcattcctgattttgtttt

SEQ ID NO: 380355 - DNA, 679 bp, Homo sapiens
gatctaccaagtagacacactcaaggatgttattcaagaacaggaactagtttcaagaagcaggaactggccagttcctgcttcttgaaacacatctcatctcctcatacctcccatgcctcatctccatcatatacaatcagttaacaggttacagtccggtccatttgtcatgataccactgcttctctttttaaatgtgtattgaaaaatagaaaaacccatcctaaaatttatatgaaatctcaagggcccctgaatagccaaaacaactgatgtagaacaaagttggaggggttcacactttctgatttcaagacttactacaaatctacagtagtcaaaacaatatggtactagtgtgaggacatatagaccaatggaatagaatagagagcccagaaataaaccctcacatatatggtcaattgattttcaagaaggatgccaagaccattcaatgggaaaaggacaatctttgtaacaaatggtgctgggaaaactgcatatccatatgcaaaagaatgaagttggattcttaccttacatcatatatacaaattaactcaaaatggatcaaacatctaaaggtaagacctactcttagaagaaaatgcaggagaaaatatgacattggatttggcatatttgtttgatgtgataccaaagacaaaggtaa

SEQ ID NO: 380356 - DNA, 1110 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagttttatggatacttcaaaaatcaagaaagaataagaagatagtaaagaatgttcctctcagccaccctgcatccatccatttcccaccccaacctgcaaaaggtaaccactggatgggcccggtggctcgcacctgtaatcccagcatcttgggaggccaaggtacagccatggcagaagatggctgggcacaagggaccagctgcacgctgctcctggagtcagctctccaggacaggcctcaaccttgggcctcttcagaagcactgctcctatttcttgccagccgatctcagcccaagccacccaagtctgcacccccctgagtacagtggagatattacattaactttgaaataaaaggagagactctaggtctcactgctcccttccagaagcttcttttgcctcttgcaaacatgggtggctttgggaggattgccagcacacttcatataccagaagcacctcagccctgaggtcttggggacatagataggttcttcatctcacgtgatggggactgagctctttttggtgggtaaagtggattgaaataaaggaggagggctgacaggaatttgagactagcctgggcaacaaagcaagaccgcatctcta

SEQ ID NO: 380357 - DNA, 1017 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggtaagcctgtcggcgccgctgccgagccttcgcgtccagctccctccgctttgtgaggcctgtagtttaccctggggagtgtcctcccgggctgaggcgcccgccctcggtgatgcggtactcctttagggaagcgagttcctcgtggccagaaaggaccggcccagtgtccgggtgttaaaaagggttgtgaccacgtgaaaatgtcctcagtgctcgaacgttgcaatacggtgcagtggaaattctttaaaggaatatggcttttatgtcttcatttttaaaaggattggtggagtcagtcccaagcaggacccgcgttggagaggggattactgatgttacaagcgcacattacttcaatcccctagatgcctcagcactaatgatcatgatcagagaccccgagttctctcgtgctgctacgcttcgcaacacatagcacaaatggaatatgtgttgacacacccctctgaagttaagatctttgatattaagaccctgacttttttccctttcattcttccgaaccctctgtgtactttgagcagcactgtggttgattaataaatcatcaaatgtgaaaggaagaaagcgaccttcctgtgtggaaaagcagggtatcttgcgaggctgtatgagagagtattcggtagaatcaggagctgtggacgcattcctgattttgtttt

SEQ ID NO: 380358 - DNA, 768 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagttttatggatacttcaaaaatcaagaaagaataagaagatagtaaagaatgttcctctcagccaccctgcatccatccatttcccaccccaacctgcaaaaggtaaccactggatgggcccggtggctcgcacctgtaatcccagcatcttgggaggccaaggtgagcagatcacttgagcccaggagttcaagaccagcctaggtaacatggggaaaccccatctctacaaaaacaccaaaattagctggacgtggtggcgcatgcctgtagtctcag

SEQ ID NO: 380359 - DNA, 556 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagttctgcatggctggagaggcctcaggaaacttacaatcatcttggaaggaaaaggggaagcagggcg

SEQ ID NO: 380360 - DNA, 158 bp, Homo sapiens
tggagaggggattactgatgttacaagcgcacattacttcaatcccctaggtctcattttcgcggtcgttttaatttttctactccacaacagacttttttttactaggggttctaagattacctacatagcttttaatttattttcatcttttttag

SEQ ID NO: 380361 - DNA, 915 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagggatgctcaggcatatggcctcagaaacatgggctattgagacagagaaaaagacaactctggaaggagagagcctggccttacagaagacatctgaactatcaatcaacagaaatctcacgtatagttgaagaatcagaaatctgagcgtaggaagaagtgggttagccctggagaaaggaaaaggaggatcatggttctctgcaaagagctggaagctaaaaagcaggctgtgtttacttaccaaccaggactcagtgggatctttgccagcttccaatatggccttaaaagtatatgaaatccaagaaatatttctgcaaagcaagagatcttcactgctttattttccaccacctgaatccttgcagtgagtgtagtgtgtatctaatcaatctattaaaaaatacttcaaaagttctaaaa

SEQ ID NO: 380362 - DNA, 959 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagaaatagaaaaacccatcctaaaatttatatgaaatctcaagggcccctgaatagccaaaacaactgatgtagaacaaagttggaggggttcacactttctgatttcaagacttactacaaatctacagtagtcaaaacaatatggtactagtgtgaggacatatagaccaatggaatagaatagagagcccagaaataaaccctcacatatatggtcaattgattttcaagaaggatgccaagaccattcaatgggaaaaggacaatctttgtaacaaatggtgctgggaaaactgcatatccatatgcaaaagaatgaagttggattcttaccttacatcatatatacaaattaactcaaaatggatcaaacatctaaaggtaagacctactcttagaagaaaatgcaggagaaaatatgacattggatttggcatatttgtttgatgtgataccaaagacaaaggtaa

SEQ ID NO: 380363 - DNA, 885 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagaggacacaaaccacagtcaaaaaaggtcttcctgagttctgaaggtcaagcaattagaattttctcaggcttgtagaagagtggaattctggaaaccagtcttcgcctcaggggagcatctgttggaagttcttagggatgctcaggcatatggcctcagaaacatgggctattgagacagagaaaaagacaactctggaaggagagagcctggccttacagaagacatctgaactatcaatcaacagaaatctcacgtatagttgaaggactctcttgtagggtaggtctaccagctgcacatgtcaggacaaggaggtggaaccaacttacgggtgtctggggaagacacttggcagccctttcctagaagccaaaatcagagccaaactccgcca

SEQ ID NO: 380364 - DNA, 944 bp, Homo sapiens
ggaggactgagcccgggagagagaggggaggggtcggcgcgcgaccgggtcatgctaggtgcagactggccggtcgcttcccgccctccagccacccgcagctccccggcaggcgaagggcggccgcgcgggtgtgggccgagagagggaggcggctcggctggagcgcgccgtccgcccgacccccgccgcctctcgggcgcctgcgctcacgctgcggggcccagcgcattgtgagccgggtcgagctccacgctggcagcgtctgagagctgtcctgggccggaggtggcgcgaaccctgtgcggcctagagtgggcctggggaagccagctgccatgttctgagtactctctggaagggcctgcatggcaaggaactgatgtttccagccagcagccagcaagaactgcaagccttgtgaatgagcttggaagcagatcctcccctcactcaagccatgatatgacaacagcctgagacccagagttttatggatacttcaaaaatcaagaaagaataagaagatagtaaagaatgttcctctcagccaccctgcatccatccatttcccaccccaacctgcaaaaggtaaccactggatgggcccggtggctcgcacctgtaatcccagcatcttgggaggccaagaatcagaaatctgagcgtaggaagaagtgggttagccctggagaaaggaaaaggaggatcatggttctctgcaaagagctggaagctaaaaagcaggctgtgtttacttaccaaccaggactcagtgggatctttgccagcttccaatatggccttaaaagtatatgaaatccaagaaatatttctgcaaagcaagagatcttcactgctttattttccaccacctgaatccttgcagtgagtgtagtgtgtatctaatcaatctattaaaaaatacttcaaaagttctaaaa

SEQ ID NO: 380365 - DNA, 116 bp, Homo sapiens
cttaaagaagaaaatatataaaataggtcaatgagaaaaagttgaaaggacaggcaaagggtaatttaaatccatacttagaagggaaacatttctctaatgaaaactgtgaaaac

SEQ ID NO: 380366 - DNA, 430 bp, Homo sapiens
tccatagctatcttataccctgctgtatcctcagcatttggcttggtaccttactcatggtaccagcttaatgaataatgattaaattcatgaatcaatcaactgatatttaagtaacttatcctccacagacataaagtttagcaatggagctggagttctaaattcagatctttagtctattttatcatcttatctcttatatctctttattttatgatgccatctattatagaatcttgatactcttttatagattcaaaagtatctatccctttcctttatttaccccacccccaacaaccataagcttttttgtaaatgggattcctttattgcaaatcggttgtaatgctataatctttacatcttttgaatttacacattgtttttgctaattcagacacatacaaagcccttgaggcatagg

SEQ ID NO: 380367 - DNA, 453 bp, Homo sapiens
aagagggtctctttctgttgcccaggctggagtgtagtggtgcaatatgcaatcatctgttgacactgcttgctattgccacaattagctaaaaactaaactaataattccacactggccactataaccctgacactgtagcttaagaatatatagtcaatcgctaatcaatgttatttctgtaaatgaatgagaattcctggaaaacaactttgtatcagcccactctttttgtatctgtcccccttttaaaaatccacttgtggccaggcgcaatggcttaggcctgtaatcccggcactttgggaggccaaggcaggtggatcacaaggtcaggggttcaagatcagcctggccaagatggtgaaatcccatctctattaaaaatacaaaaattagctgggtgtgatggtggacgcctgtaatcgcagctacttgggaggctgaggcaga

SEQ ID NO: 380368 - DNA, 547 bp, Homo sapiens
  misc_feature (494)..(494): n is a, c, g, or t
  misc_feature (497)..(497): n is a, c, g, or t
  misc_feature (507)..(507): n is a, c, g, or t
  misc_feature (540)..(540): n is a, c, g, or t
  misc_feature (543)..(543): n is a, c, g, or t
cgcctgtaaacccagaactttggaaggccaaggcaggtgtattgcttgagcccaggggtttgggaccagcctgggcaacataagtagactctgtctctacaaaaaatgcaaaaagtagccgggagtggtggctcatgcctgtgatcccagctacttggaaggctgaggcaggaggatcacttgagcctgggagatggaggtggcagtgaggtgaaattgcaccactgcactccagcctgggtgacagagtgaacccttgatttaaaaaaaaaaagtagaacttacagatagaaaagtacacaaaataatatagatttatagctgaattaattaccagaaaacaaaaacatctgtataactactatccaggtcaaggaatagaatattaccggcatctaagaaattacccccttgagttaccccttccaatgtttatcttcttcatcttccccagattattctgattttttttttttcttgaagtgagcagaganttnccactgcacntcaccctgggtgacagagcgagactccatctcnggnaaga

SEQ ID NO: 380369 - DNA, 1783 bp, Homo sapiens
gcggtcctctgcgcgggatgtggctctgagcttcggggtagtccgcgaggctgggttccgtgctgaggggcgtcgcgtctggccgtgcgctgcgggagcgcgcgggcctggcccgctgtcctggccgctgcgaggcgctcagcttctttctgagtgttccgccgggttcgacagggtcgaggtcgccggcgcgaggctcccggatagctgaggggcgcgagggcgcctccagtctcccacctgccctcccgcgccgcggactaggctgccagtctaccccaccgggacgtctgcccccgcatgcaggagggggtgtgtcggcccaacggggtctcaggacctgtccctgctcctccaaagcccacgtcgcctgcggcgcccctcgggtctgcgccgcgttctcctttagcctcccgggcctctccgctgcccctcgcccccaggcaccagccacacctgcttccttctgttcccgcccgtggcctctgacacgccgtgccctggacccgaaatgcccgccccactcctggagcctccggtgtgtgagaggcacctttccttggggtcaggggcccggactctgaagccggcctggctttgcctgtgggccccgatcctcccagctcgagtccctcgccccagccgccgcgggccttcacctgtgctttggggacgacaggatggccaccctccttcccccaaagatttgagggttttgctccacgcgggagaaggtctgcctgtgccaccagccggcagcctttcacatgctgttgcgttacggggccctctgtgacctttccctaggccgaggggtgcttcgtctctgttcctgagagaccagaatttattcttggtttgtcaagccacatctgtaggaatgttgcccagttgcagcaggctggggtctgggacttgctcctttggcgaattgagaagtaaggatatagaaggcattttagcactaatggaaaccagaaccactcttagacctgggcaagaggggccccagaaattagcaagcgattagcaagcagctggatttcgatgacctccactgtacttagagcaacggcattcgattcgttggatcatttcaaagatgacatactgggttgtttgtttgtttctggcggtgtctaaagatggaacatcttgaagcattttgaatttgacctgtggctaccctcagatacaatgatggtaaccccatgagtgctgttaaagcaatttgacttattgtagacaggttaacacatgagatgcgttaaaagagttaagtgaaataataggcagcattcaaagagcaaatcgtggtctttggcagaaaatagagttaattttgtatttgagctgtccagttattacaattagaaaacgttttaaagaatccaaaaggatttaaaatattgcataaagttttaggagaaaatggtttccaaaaagcaactgcatatgaaataagcactaaaatgacattaaagtacaatgtaagaaaatcggaactagaagcatttgctggagtctgaagaaaaagatttatggatgaatgattctgaaactaacttctatagagacaattttccggcgatggtagatcaaggtgtagattgtactgaagagagagattcaaacaaagtgagtaatctaccgcagttttcagttttcttggtaataccccaacaacgtaaaagaaaaacgtaagaaatcctgtatggatctaaatgtaagaaacgatgataatggtgaaataataacattattttatataatgaaaaaattg

SEQ ID NO: 380370 - DNA, 412 bp, Homo sapiens
atgaaaactagaccataaaaagtactcttcttcacagataagggaggcataggagaagaggctttaagaacaagggatactcctcacttgctgggatacatggtcttccctgggggaaggtggaaaggctcaatttagattcaagaaaaatttgagtatcttgtacatgttgtgcactgtgccggtgagttcacatatattattttatctgccataatgaggtagtattcaaggctcagtaagttaagcagtttctcccagatcacccagctagtcagtggcaaaactgggatttcagcctcagttcgtctagcaacagttctaccataataaaggcagatttaacgacctcccttccaaagggcattcggtctcctcttcagcttcaggcacagaggagaaaaagggatgg

SEQ ID NO: 380371 - DNA, 381 bp, Homo sapiens
ttttatatatcaacttggaaggtgttttgggatgagattaacgttcaaattggtgaaccttgagtaaaatgaattgccttctttaatgtaggtgggcctcactcaatcaattggaaacctgaatagaacaaaaaggctggcctccgtgagccagaaggtacccccccgcagactcctttctagacttcatctgcaccattggctctcctgagtctccagcctgctggcccacactacagattttggacttaccagcctccataattattacattagccagttagctataatacattttttaaatatatatctctcctgttgattctgtttttttttttttttttttttttttaactctgactgatacaggtggagttaggg

SEQ ID NO: 380372 - DNA, 467 bp, Homo sapiens
aattatagctacatggtgatactatattccatctaatggactggcagatattgaaaaggaatgataatgtctggtattggcatgagaacaatgaatttatataatatatggtgtgagtgcaaatggatacaaactttctaaagggacattttccttaattatttaggcttaattccctggaagcagaattgactgtcaaacagattgcatcaaggcatttgctgctttgaagttgggttgaagggtacattcagactcagatccaattccactccttccatgacatcttacatgattttcttctgctcctgactcttcatatttcttaaagaaacaatttgccataaaggaaaaggcaaggactttgaaatcagacctggggctttccccctacttgggtaagcgatttggttctctgagccttggtttctacacctgtgaaatgggagttcataatacttgcctca

SEQ ID NO: 380373 - DNA, 2532 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380374 - DNA, 2805 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtgagcgtcttgtgaccaaaacaatcacaaatcgaaacaaaaaaaaagggggggcccctccaaaaattcccccgggggggccccattttcccgttcccccgcgtttttgtggatagcaagtgggcccccctttgtaggagcgtctggcttttccaaccctgaaccgcgcggggccgctgtatccacccccttgtgatcgggaccaccctcgctggccgggaactgtttggcgagagccctcatcctctctgggggggcacatcttggggcctgtccccccggaacattttagacgtgctaggagactc

SEQ ID NO: 380375 - DNA, 2390 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaaatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380376 - DNA, 1810 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380377 - DNA, 1617 bp, Homo sapiens
ggtgaattggtgggcgtcagtgcagtaagtgaggagccggacgtcgattgactggtcttcagaagcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380378 - DNA, 583 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggtgagtgtttcaccctcgagagaggaagccttgtgcatttcaagggacactgttcgtctttctagttagtttgctgtttc

SEQ ID NO: 380379 - DNA, 2339 bp, Homo sapiens
ggtgaattggtgggcgtcagtgcagtaagtgaggagccggacgtcgattgactggtcttcagaagcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380380 - DNA, 2305 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatacgggatggaaggtcgatatagagaactaa

SEQ ID NO: 380381 - DNA, 2087 bp, Homo sapiens
actttaagtaacttcgcaactacaggaggcagctgccagcaaccgtatttttctcatggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaaaaaaaaaat

SEQ ID NO: 380382 - DNA, 1621 bp, Homo sapiens
gctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgtcagtcgtggcggtcgctcccttgcatcggctcaaccaattgagcacggggcattaaggggggcggggttccttcttcgg

SEQ ID NO: 380383 - DNA, 249 bp, Homo sapiens
ccatgaagccctttcacattcatgagactggttattctcatgcaactctggaatagttattattactcccattttgtagacggattctctgagtcttggagactttgtctgaattcctaaaggacaaataacaaataacagaggcagaattcaaactctggtctgcttggttccaaattccatgatcttcccatgatatcctgctgcttcctgccagggccacaacaagagtttttttctgggctggtt

SEQ ID NO: 380384 - DNA, 466 bp, Homo sapiens
tggaatttaaacagtattccagaaccaagtcactgcacttctgttctttctcagtctggtgaagactcttagtactggagcttaaacacttccctggaactatattgctggccttacattatttcccaacctgggaaatccttaagtgggtactgcaacttaatcctgaccttttagttgtttccaggccaaggaaagactttatacagtcacctgggctttgtggaaaatacatctagggatttgatccttcgcttggattgtgccccttgcagtgcttttgcactggccactcccttcaacatggcattcccactggccaatgtgccgagtggctgccaagatccgtgcaccagttgctgtgatgtgcaccagttgctgtgatcagcaccctattctttctccccagttcaccccaggtgtttctggcctccaggcactcccagtggttccgtgggatggaact

SEQ ID NO: 380385 - DNA, 287 bp, Homo sapiens
taaaataaattagatgccatctagaaattttccttttcccttcattcattatatgtgtctcataagttcaacaaaggcaaactttaaatgatattcagttgaaatgaatacagttccaaactactgaattacacagcaatactcttaaattgtggttctagaggggcaaggtctagatgtcaagagttgtggggcccctggctacttgtgggtaccttgtaggccctgcagtcactgagacccaggatttcagtctctactcttctaagttcagaacctccatcttt

SEQ ID NO: 380386 - DNA, 589 bp, Homo sapiens
gctgggcatggtagtgtggtatgcctgtggtcccatctactcaggagggtgaggtgggaggattgcctgagtgtcggaggtcaaggctgcagagtcgtggtcacactattgcactccagccaggatgacaaagcgagaccctatctcaaaaaaaaaaatgaataaatgcaaataatcaatagaatggctggcatttaatgggtatctattaaatgtgttgggcactatgctgtatatttctgataccttattcatttaatttgctcaataatcctatgaaacaaatattattcctatttctcaagaagaaaaatagacctaataatagttattttccaaaattacatacctagaaactgggacagttcatgacacaaaaatttatattctttttactgtattaacagttttcaagcttttgaatctcaggactccttttatacttctaaaaattattaaggatcacaaaaccttttgtatagatatatctattgatatttatcatattagaaattaagatttttaaaattttaaatgtattaattttagaactataatactcactacgtgttaatataaaatttcttat

SEQ ID NO: 380387 - DNA, 1360 bp, Homo sapiens
gcagccttgacctcccgggcccaggtagtcctcccacctcagcctcccatgtagcaggaaccacaggcaggcaccaccatacccagctaatttttgtattttttgtagagatggggtttcgccatgttgcccaggctagtcttttctttcttctctttttttttccccacagtatatattatacagcagtcataatatctataaatacatagagtttatgttgtgaagtttcccagttcactgaaatgttaggtttcctaaagggtacagtgccgtataaaacaacctgcctcatatatttctcctcaaaacgttggactatttgggaaaaggaaaagagttgggaaaattggttttaaggtaagttttagtcaaaagaattctttcttgaaactagctggtttgtggattcagatactctgatccttacagaatccaagaggaagctttcataaaaacaattcagcaaatatttccaatataatttgaatggctaattttcagttgctaattaattagcagctttgtaatacttgatttgggagcatttacttggaaatcctaaggactataataaaagttttcaacatatttctaaattgtgtgagtttccagctgtagcttttgtctttgtcacattttaaaaaataataagcaagacacattggggacactggcagcagttgccaggttttagctgccaccgcttcagtatgagatatagctgtcccatcttcccccattcagggtaggagatatagtgacccagacttcatgcaaatggaaaaaaagttttaactgaaatatttatttagatttcagggtctagatggatgggaaagtagaaaaacatatgcaaatctcagtgttctcactatgaccactcttgagcagagatttggttttgtttccttttgtaacaaagtgaaaacaggtgagacaatgtgcccaaaacaaagggaagaagagaaccttctgtgactcctaaaatgttccatgctgcatttttgtttcattttttatttttccttgctttgtttttaaacatgaatataatgcttacttcaaattgtttagtaaaacaaaataactaaagaaatgtgagcttcccaaggtttctaaactatcgctgttgtatattctatagcgttccttattctttgagggaaactgtgcttgctgtgatccattttgtctctagcttctagttgtgattcttgtccataagcaccaaatttgatgcccatgatttcaaaaggtcatttcttttatctgaatgaaaatggtggtactaagactgtgaaaattatgtgaaacctaaagtagttgccaaagtggctcagggttgtaaaattcattg

SEQ ID NO: 380388 - DNA, 319 bp, Homo sapiens
ccaggcaggttaccttaaaataccttgcccaaagtcacttaaagtaattcttctctatggttctgtcaccaaactgctgggtaaatcaggtttgtttgtttcagtttctctttagtgtttgcaagtggatctgatttattttctttttggttgaatgctgctttgtaaattgcataaaacattttcatggttccaaagtcagatctatgaaataaggcacatgccctgtcctctcaactctgcctcccaacccctacaccagataaacagcttttattagtgtttgtttatccttctgtcatttcattgtacaaatacg

SEQ ID NO: 380389 - DNA, 286 bp, Homo sapiens
ttattaatggctaaagatgtgtgtttttcattcactgacatttgttgtctttttgcttcctatagagctcatgttctttgaccccttaccaagttgaatctggatattaactttgtttttttatttaaaaaaaagtactatttaaaacttacaactagggctgggcgccatggctcatgcctgtaatcccagctacttgggaggctgaggcgggagaatcactttaacccgggaggcagaggttgcagtgagccaagatcgtgccattgtattccagcctggatga

SEQ ID NO: 380390 - DNA, 1196 bp, Homo sapiens
ccgtggctgaagtcaagcaggagaatggcagaagatgaggttggatgaggctggatgaagtagaaggggcccagtggcatgggactttggatttttctttggagtcagaaacccatacaatggtacaatggattgacatgtgtagacaaatgccgagacagccacgaaaatctgaaatccatacatataaatacacaagtggacaactacataggaaaatccacttaaaatacatgcaaatatatggggggaaattatgggacttgatgaatcagagggttggtgtacagaaagggaaaagaagtaagaaaaagtgacaagatgggagataattgggtgactattagaaaccaatgttaactacaagaattcaaagtccaggtgtagcccagaacgaggtttcttccatttggtgcctcccctgtcttctggggcctcagagtctgtccttgtcccctctgttgtccacttgtgacagcagacggggagagagaggtagtggagggtcacaaggggtctcaagggccagaccttcaagtggcaaacatcatttctgccctctttccattgcccagaattttccactggcccactgtactaccaggagagattggggtagggcaggctgagaaatatactactcctgtgtgctcgggaagaaaatatattgtctctgccttgtctggactctcagtttaccttctctcctctgtggtttgtttcaggactaggatctgagctcatcacttaagagttgtcatagctatccttggtcatccctaacttgggagcctcccaaatatctaagaaacaggctggtggctctagttctcttcacaattaacctccaggttcactttcttagtctcacacctgggactagaggaaggacttaaactcatacctaacttcaccttttgatcttgatgcccctgggtgtgtagtgccagtcctgagcccttggtcatggggcctttcctgtaccctcaggacccctgactcatggctccccaccccccaaccccatgccattgccaattctctaaatgcattcacaaacacaaaagaaaagaacatctttttctggaaaaagacttcaaacatgtaaaaacaccttttattatttgtttatttgtgaatacaagggtgtggtcttttatctaaagcattaaccaagtggagggtggcaggttata

SEQ ID NO: 380391 - DNA, 909 bp, Homo sapiens
gcattgtcggtgttgtataatactccttttggtgaatagtgccacgatttatagattagttgtccggtgaatagacatttgggtttccattgttttgctattgcaaacgtatgctgctatggacattcttgaacctgtcttctggggcctcagagtctgtccttgtcccctctgttgtccacttgtgacagcagacggggagagagaggtagtggagggtcacaaggggtctcaagggccagaccttcaagtggcaaacatcatttctgccctctttccattgcccagaattttccactggcccactgtactaccaggagagattggggtagggcaggctgagaaatatactactcctgtgtgctcgggaagaaaatatattgtctctgccttgtctggactctcagtttaccttctctcctctgtggtttgtttcaggactaggatctgagctcatcacttaagagttgtcatagctatccttggtcatccctaacttgggagcctcccaaatatctaagaaacaggctggtggctctagttctcttcacaattaacctccaggttcactttcttagtctcacacctgggactagaggaaggacttaaactcatacctaacttcaccttttgatcttgatgcccctgggtgtgtagtgccagtcctgagcccttggtcatggggcctttcctgtaccctcaggacccctgactcatggctccccaccccccaaccccatgccattgccaattctctaaatgcattcacaaacacaaaagaaaagaacatctttttctggaaaaagacttcaaacatgtaaaaacaccttttattatttgtttatttgtgaatacaagggtgtggtcttttatctaaagcattaaccaagtggagggtggcaggttata

SEQ ID NO: 380392 - DNA, 306 bp, Homo sapiens
tgaccatggatgacccaccagaatgtcatgggatccagctacagccaaggaagcacagagcaccgtgggagcgatttattgtgcttggggatggggaaggggacatgggaggagccatattgagaaagtagcatgggtacttggcttcacagagtgtggcagctttcatcaggaagtgatggtgggggaacagcgtctctggcggagggaagcagcaggtgcagaggtgcagaggtgtgaggagtctgtcacattctgggaagggagtatggttgggtgacaatgcaagacagagaaagcaaggag

SEQ ID NO: 380393 - DNA, 393 bp, Homo sapiens
gagaaatggtaacaagtggttggattatgattatagttgaaggtcgaacaactagatttgctgatagattggataaaatggtcctctctttatggatctcataatacagtaggagaaacagacacataaatagtcatcactgcaggatgggtattagaaatattttgcaagggtgtaaaaggtgctaagaaagctttcttgtgtgacaaagctggttaaagaaagaaaagaaagcttcctagaagtgaaacctaaaatatacacttagataaatgaataaaagttatgaaagaatgtgagggctgggcacagtggctcatacctgtaatcctagcactttgggaggttgagtcgggggtattgcttgagtccaggagtttgaaaccagcctgg

SEQ ID NO: 380394 - DNA, 969 bp, Homo sapiens
tctcagatttattttggactattttgatgccaagtgagtataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaattcagtcactatactctggcacaattttcattgtgtatatgagccaaaccacataccttaatgattggggaagttaggcaaatatgagatatgtagacatatctatgctgatcgttgcttgagaaataattactaattctagaacaaaatcaatcctgtatctttccatcatgaatc

SEQ ID NO: 380395 - DNA, 688 bp, Homo sapiens
  misc_feature (2)..(2): n is a, c, g, or t
tnacgtgatcttccgagcccaccacggtcttttcaaagaccttataatctattttggtcacttctagtcaatgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgaggtgagatagcgccattgcactccagcctgggcaacaagagcaaaactctgtctcaaaaaaaaaaaaaaattcagtcactatactctggcacaattttcattgtgtatatgagccaaaccacataccttaatgattggggaagttaggcaaatatgagatatgtagacatatctatgctgatcgttgcttgagaaataattactaattctagaacaaaatcaatcctgtatctttccatcatgaatc

SEQ ID NO: 380396 - DNA, 227 bp, Homo sapiens
cttcaagtgtcagggatggacgaatgtccctgtcaggagatgttggtccctggcagccaggcatggtggcagcactcccagcctggcctgccctgcacaaaccttcaggcacacaggcctcttgacagagtgatgattgggattccatgcctgcaccagtggtgggagagatgcaggtgaaacaaggcggaaaggaccgtaattacctcctaacaggtttccacatt

SEQ ID NO: 380397 - DNA, 451 bp, Homo sapiens
tctggcctatggtcattaacaggcttttgggacctttcagtagtattttcagaaaaatgaaaatttaaattcttagtaattacagtgagaaaactgtcatctggaggtaagacccctctccaaaggcttcacaaagttttggtgtattaaacctttccggattaaaaaattgtttaaaaggccagatgtggtggctcacacctgtaaaacccagcactttgggaggctgaggctggatcacttgggcctaggagttcgagaccagcctgggcaacatgtggaaatctcatctctacaaaaaacataagaattagctgggcatggttgtgcatgcctgtagtccctcctactcgggaggattacctgggcctggggggtttgaggatgcagtgagccgatattgcaacactgcactctagcctgagtgcagccgacgcaagaccctgtctcc

SEQ ID NO: 380398 - DNA, 1350 bp, Homo sapiens
ggcctagttcttttatatcttttaccttggtctcctaacctaaaaatgaagaatctgaattagatgaacatagaagtcacagctagctctcatatactgtgaatcatttttcattttatgctctagatgagtcattgaccaagcaagcactgtcaaggatggtagtattgtggcaagctgaaaatttatgctaaacaattttaatctgccctgaacccccagccatccagttggtgggatattcaatctcactcctcagtagggttctctacctcctcaggtcccagagaatagctggtgggaggagttggagaagagtcctctagacctctgtccatgctggtctctgttaagttcaccatccctgcccacatggtcttctgacggtaggcaggggatatctgtgccattgctcccaggactatattcttggagtccaccagcctgagactgtgcaatcctggggtgatacttttgctcagcacagaatcacccccaccgcctcccagaacccgactccatctgttagtctcaggaatcttcctctccccttgggtcccacagcttctacctgttaagtttcatgcacttactttctacataactctcactgagccaaggttattgcaaacaaaaggctaagaaggagttgtcttctcttgcttggcaatgtctgcttcctgatggaatacaaaaaccacctaggtaaaaacaaaaacaaaaaacacaagacgtggctaccttcttagcttgggaaagggaaaaatatctacagcagcaagaataaaggacaaattactgccttgataaagtagcagcctgggtgacagagtgagattctgcctcaaaaaaaaaaagaagactgcaagtaatctgtattcaaaacaaaaataaatgcagataatacaataatacagaagagtataaaatgcaaagtgaaaggtcttcctaaccagtttcaatcactagtggcaatcctgtcaacaatacctggttttatttcttcaaaggagaggcattaattttataaaacatacttttattttctgaaattttcacatctttcccttcttttacaacccatggtgtcctctttcttgtattctttttttatttccctgaagcaatttttttaaaagatgcatgaacagtaagcattctgatcctaacatctaaacatgtctacagtgtgccctcacacttacctattagttggctgggtatattcaggttgaaaatctttttttttcttttttttttttattatactttaagttttagggtacatgtgcacactgtgcaggttagttacatatgtatacatgtgccatgctggtgcgctgcacccac

SEQ ID NO: 380399 - DNA, 319 bp, Homo sapiens
ccaacatggtgaaacctcgtctctactaaaaatacaaaaattatccaggcatggtggcgcccgcctataatgccagctactcaggaggttgaagcatgagaattgcttgaatccaggaggcagaggttgcagtgagccaaagctgtgcggctgcactccagcctgggtgacagagtgagattctgcctcaaaaaaaaaaagaagactgcaagtaatctgtattcaaaacaaaaataaatgcagataatacaataatacagaagagtataaaatgcaaagtgaaaggtcttcctaaccagtttcaatcactagtggcaat

SEQ ID NO: 380400 - DNA, 307 bp, Homo sapiens
attatattggacttcagtgttttatcggagcatgtaattaccatagattgaagagctgtctataattaatttgctctacttcttattctcattgttcaacttaccaaaccttctagtaccttggtgatgctttatcgacctctgagaatccctttgtgatctgcagtgctactgtggttcacaaaatctgtgttcttgctctccctgatagcatctgacatttgtcatcaggggttggcaatcccatatacagggccccatttactacataccatagccagtcaccaaattagagaaactcagttta

SEQ ID NO: 380401 - DNA, 736 bp, Homo sapiens
cgggcggcggcgtgagggctccgggtcgctggcggcgtggacacctgagtcccggggtaggggtctcccgcgaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcc

SEQ ID NO: 380402 - DNA, 543 bp, Homo sapiens
ccaatcagatgtctggtcaagattgttttcaggtgagattttactttaggaaaatctggttttggtatctttttcagtgatggcgaaccgacactaggaaacttcttccctcgaggcctgttaaaacccagcctctctaggagtgagctgttgccgcagaatgggctgctggctcctgccctgcttcctgtgatcgagccggccctgaggactctgtggagatgcctggctggggcctcctggctgagcacgcaccgcaagctccagccaccggcacagagaactcttccctaaaggaatctggccgagggcttgtctcccttttcccaagaactgagagagagagaataacctgttagacccataggtttccgtgatgtgtaaatgccatcttttgggggttgggaggagtaggactggtctgattatcattcttgagtctcatctaccctcttctcgaagtacatgacatgaaagttcagatcccttccactcaggattctcgccgccttttctaagaaaataataaaaaaaaatgcttgt

SEQ ID NO: 380403 - DNA, 802 bp, Homo sapiens
ccaatcagatgtctggtcaagattgttttcaggtgagattttactttaggaaaatctggttttggtatctttttcagtgatggcgaaccgacactaggaaacttcttccctcgaggcctgttaaaacccagcctctctaggagtgagctgttgccgcagaatgggctgctggctcctgccctgcttcctgtgatcgagccggccctgaggactctgtggagatgcctgtaacccaccggaaatcagacgcatctgacatgaactcagacacgtcccccagctgcaggctccgagccttcagcagaggcggcagcctggagagtcgaagcagcagctctcgctccagaagcttcactttggatgatgagagcctgaagtacctcacccatgaggaaaaggatgtgctcctgttttttgaagagacgattgactccctagacgaggactttgaggagccagtgctgtgcgatggaggagtgtgctgcctctgctccccgtctctggaggagagcacctccagtccctccgagcctgaagatgtcatcgacttagtgcagccagcacctggcgccggggaagccgagggccttccagaggggacccaggcagcagggcctgcacctgctgggaaggagcacaggaaacaagatgctgagactcctccacctccagaccccccggctcccgagacccttcttgcgccaccacccctgcctagcacccccgatccccccaggagggagctgcgcgccccctccccgccggtggagcaccccagactcctgcgctctgttcccacgcc

SEQ ID NO: 380404 - DNA, 152 bp, Homo sapiens
ccggtggagcaccccagactcctgcgctctgttcccacgcccctcgttatggcgcagaagatttccgagaggatggcggggaacgaagccctctcgcccacctccccgttcagggagggccggcccggggagtggaggacacctgccgcccg

SEQ ID NO: 380405 - DNA, 296 bp, Homo sapiens
gcctcagcctcccaaagtgctggaattacaggcacaggccaccatgctcagcctcatttttatactattttagactttatgtttaaaaaaattttaagatgctattaagtcttgaaacaaacatttttcattcattttctaactcctgggtaatttgctaggattataaactacttaaatttttttgctttagtttgggtgcagtggctcatgcctgtaatcccagcactttgggagtccaaggtaggtggatcgcctgaggtcaggagttcaagaccaggctggccaacatgaca

SEQ ID NO: 380406 - DNA, 641 bp, Homo sapiens
tgtcacctccactaggcagggacctcccagggcagggacggacgcacctgtcccagtcatggctgatcagcgagagccaaacatatcatagcacatggggtactgtaggtgttcaaaggatgctggctgaatggatggagacttccttcatagagccccattttccttcctgatttcttagtctcagttcccattttctctcaaagatccaggggtcacaatgagagtgattataaaacaaactacacatgcaacacgaactcctcagtcaatcccaagagggctctcactccacacttcatcatctgccctgtgacctcagattaaaactcaggcttaacatttcctgaggccctgctcggtgccaggttctgggtctgtgctttccagttgttttatgtatccttgataacctctgtatggttggtggtaaaatggagagatgtattttcctgcggggaaactgagtcctgagaaacgagctagcccacagagagctggtggctggtagagcccggatccaaaattgggagcgtcttgccccaagtccagtgctgtttcctttatacccaatgccacagagccaaagtggtacctggccgagatctggccctgaatgtagaagaggccagggaaaggtg

SEQ ID NO: 380407 - DNA, 437 bp, Homo sapiens
ttttttttttgggactgccccaaaggaatgcaggtttattgggcagcagctgggacacccaggttggagtgcacccaggttggagtgcagtggcgtcatcttggctcactgcaacctccgcctccctggttcaagccattctcctgcctcagcctcccgaatagctgggattacagacatctaccaccatgcctagctaatttttgtggttagtaaagacagcgtttcaccatgttggccaggctggtctcaaactcttgacctcaggtgatccacccacctcggcctcccaaagtgctggtattacaggcgtgagcctctgcgcccggcccagactcttcctttgtatccatagccagatgactgaactgtctgttttgactttttacaacatactatgtgtgtgtgctaaacaccgggaccccttagctggtgtc

SEQ ID NO: 380408 - DNA, 697 bp, Homo sapiens
tgtatgcatatatcagcagggatggtgaaatattgaaaaaagaaaacatatatcaaaacatcatgttataacctgaaatgtataccagttttatttgtcagttatatctaattaaaactggtaagggaaaagatgttggaaagttaaaaaaaaaaaaaaagtttaggcataggaaaaagcaaactaccttctcaagtctgtgttcattcacccagactctttctttgttttttgtttttgtttttttgagacagagtctcgctctgtcacccaggttggagttcacccaggttggagttcacccaggttggagttcacccaggttggagtgcacccaggttggagtgcagtggcgtcatcttggctcactgcaacctccgcctccctggttcaagccattctcctgcctcagcctcccgaatagctgggattacagacatctaccaccatgcctagctaatttttgtggttagtaaagacagcgtttcaccatgttggccaggctggtctcaaactcttgacctcaggtgatccacccacctcggcctcccaaagtgctggtattacaggcgtgagcctctgcgcccggcccagactcttcctttgtatccatagccagatgactgaactgtctgttttgactttttacaacatactatgtgtgtgtgctaaacaccgggaccccttagctggtgtc

SEQ ID NO: 380409 - DNA, 239 bp, Homo sapiens
ggtgatgtgcacacgctgctgatgtgtgggctggtgacagctgattgacagcccaagactgagagacaaggaagatgaagcttgcttagaacgcctgacgtgcactgtttatgcagcgctttgagctcaggcgctggtaccttaacccgttcgaggtccaggcatgctgtgccaggctgggcagactcctggctgtcctggggctagaagctgcagctcttccttcatgcttccaggga

SEQ ID NO: 380410 - DNA, 1027 bp, Homo sapiens
attttttttgtattttttagtagagacattgtttcaccgtgttagccaggatagtctcgatctcctgacctcatgatccgcccgcctcgacctcccaaagtgctgagattacaggcctgagccaccgcgcccggccacatagttttttttttttttttttataatacagactttccatgaactttttgaaaataccttgtatgtacaccacaaaacccattttctttatccatcctaaatgtcaatgggcacttagtttgtttccttatcttggctattgtgaataacataacaatgaacaggggagtgcagacatgtttacaaggtgatgatttcctctcctttgggaatatactcaggagagggattgctgcatcatatggtagttccatttttaatttctttaggaacctccatactgtttcctataatgactgtaccaatctacattcccactaacagtgtactgtggacctgaaaccataaaactcctagaagagaacacaggggaaaaacctcttgacatttgccttgacaatgattgttttttgaaacggaatctctcgttctgtcacccaggctggagtgcagtggcgcaatcttggttcactgcaacttctgcctcccgggttcaagcaattctcctgcctcagcctcccgagtagctgggactacaggcacgtgccaccacgcctggctaatttttgtatttttagtagagatggggtttcaccatgttggccaggctggtctcgaactattgacctcaaatgatccacccgccttgacctcgcaacgtgctgagattacaggtgtgagccactgcgcccggcctgatttttctttttcttaatatcacatcagaagctcaggctacaaaaacaaaaataaataaagggactacatcaaactaaaaaattctgcacaggagaggaaacaatcaacaaacttgaaaagcaacctatggactaggaaaatataattgcaaaccacatatctgataaggaattaatatccaaaaaatata

SEQ ID NO: 380411 - DNA, 383 bp, Homo sapiens
tggaaatcaaaatttaaaaaacaataccatttacaatagcgccaaacccaaagaaatacttatgtataaagctaataaaacatgagcataatctatatgctacgcaaaaaactacaaagctctaacaaaaaaaacgtcaaagacctaaatacatggagactatgtcatgttcttggtttagaggacttaatattgttaagatgtcaattctctccaattcatctgtaaattgaatgtaattccaatcaaataccagtgtttcttatagatatttgacaagctaattctaaaatttataaagaaaggtaaagaaattagaacagccaaaacaatcttgaaaaataagaaaaaaattgaaaggctcaatatacctgatttcaaaa

SEQ ID NO: 380412 - DNA, 370 bp, Homo sapiens
ctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagagctgaaaaa

SEQ ID NO: 380413 - DNA, 567 bp, Homo sapiens
cccccccccgagagtttttatttaataaacaaattatatgaagacatttttttttttaaaaacctggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcactcttagccagagttaagggcccgggattcccagcacaattgtgacacttagctgtggggagtcctccatgcccttctcaggcggtgatgggctgc

SEQ ID NO: 380414 - DNA, 282 bp, Homo sapiens
aggcccactctagaggttcccctgctcatccctcctatccctccttggtggaaactaattctaagccagactgctggagatcaccctgttctagtgtgtggaggcttccaccaggaggtaagtcaaaatggtttctgccctctagtttttgataggtcagctttgtcctgagcaggatctctaccatttactttttccctgacccagattcttcaaagtgattgtctttgtctttcaattatttgaggcaaacaggttactgaaggagggatgagcatgagg

SEQ ID NO: 380415 - DNA, 907 bp, Homo sapiens
  misc_feature (857)..(857): n is a, c, g, or t
tgacagtggagggaaaggcccagacaaggttttttgacaagggcggggccagattgtcactaaagtgtcccacggataacctcgggggaatcactgcccccacaaggagggaatatttgtctattgaagatctctgccctgagtctgtctctttaaatatgaagccacagatgtgcccaatacaatctcggcgctcgtgtataagaatgatatagtaacgccctgatgcagtctcttcttattctcacaccttctcccgtcgggtgtgcccccgggcgtagtgaccacacaaatggggtgccacatagaggtgcacacacaagacgcgtcactagggggagtagagccctgtgtccccgcgccagagcagcccccacgcgtcacgggcccaatatcagggtcacgacgccagcacccgacgagagcgaccagatcccctgtcgcgcaatcacgacccatgaccagagattcagagtgggttgggctagagaaaccatctactatatacatgtgtgtgtgtgtgtgtgtgtgtgtgtgtgtgtgtgtgtgtataaatgcttgtgcctgggtctgtgacccaagttccaacacaaagacactttgtactggaacgctggagccattccaacatgaacagcaagaatagaacctgtgctggctggtctaagatcaacctcgagatggtggtttgaagttcttcttcaaagaaagcttgaaaatgaaatctcagtaggcaagacagataaaagcagagttattctggtgcggcggaaatgggaggagggctggaaacctatcctttgcctccactcccatcttcccactttagcatcccctgacaagctctgtggaatatncggggttcccctcgtccgattaaccccggcctcgacctagcctatgttgg

SEQ ID NO: 380416 - DNA, 808 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggaaactgcagctgaggagccattgcagtcccatctccagaagacccccagaaagagttggaagagttcttcaggctgtggcagccactgcccaccaacacacccaaatcaatcaagatgaatcccaggtggtgaggctgaagcagatggtttggtagctccagtctttttttaggcagaaatgatgtattaaatcactacattgatttttttgttgttgttagcagttgtgggtttgaaaaaaggtaggcaggaagatggtgaaggggtcaagcctaggggctgttatcttgaatatatgcaaattaagctgattatattgtagtgccctgtaacctgttcctggaaacagtggtcttgaaaactcatcagttaaatgaggtgttagacagcctggtcaaaagattctgtgactaagttactgtataatcatttgcaattctctttcttactctaaacattgttttcctcatttttatattgaaagagttaagagatg

SEQ ID NO: 380417 - DNA, 461 bp, Homo sapiens
gccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacagcgcctggagaattcaccaagttcaactcccaagtgtccaagcccaggcggctcatggcttcccggaggtactactttgagttgctgcacaagcaggacgaccgcggctcggaccacgtggaagtgggctggcgagctttcctgcccggcctgaagttcgaggccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380418 - DNA, 261 bp, Homo sapiens
aggagtctgaagcacctgtggagccccagtggctggtgcagataagcggacttgggtagagcggccagaccagctttcctgagtggcctttcttctcaggctgtccaggctcagggaggcgagagccagcaggaggcccagcgcctccaggcccagctgaatgaactgcaagcccagttgagccagaaggagcaggcagctgagcactataagctgcaggtaaggagcccagccccagcccatgccaccttcctcctgccc

SEQ ID NO: 380419 - DNA, 7241 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380420 - DNA, 6896 bp, Homo sapiens
aagtcaggcccgcgttccttttcgccaagacacatttcattcgaagaaagaacgacctctctatctcatactcttggagcaggtggtgttggtgaccccgtccagagaagagagtgtgcccatgctgcccgcactgtgaccatcctggtttggcaattcatcgtccaggatgtctgtctcccgctcagatgctaacgccccaccgagaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380421 - DNA, 7365 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagacataaagcactcatgacaattatacctgatttgtcccccaacaaccctctgagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380422 - DNA, 3871 bp, Homo sapiens
tgagatcctcactctgaccgagtcccccacctctgaccgagttcccacctctgaccgagtctcccttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380423 - DNA, 3295 bp, Homo sapiens
ggagcagagggaagggagaatttcaagaaggagcatcggcaagcagaacgacactacaggtcacgctaagactgcaaggtgtccggtggagttagggagagaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380424 - DNA, 2267 bp, Homo sapiens
ctttacaagtattttcttattaaagcttcacaaccctatgaaatagatacaattacagtctctgtaaagaacttgagtagcatatctaaagtcatgcagttaaaaaacagtttcaagaagcaggaactggccagttcctgcttcttgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380425 - DNA, 7725 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgagaaaacacgacatatagataatagcactgatatttacgagacagagaaaacagacaggggggggcgtcgaacagagaaatatccccagggggcgcaccctgtagaccagcgcgacattttggggaaggggggggcgccccgtaagagagggctgagataaagacacagagcgggggggcacgtgtaaccaagggcgaggtggggtgacaactggtccccaggcggtactggggagaggcaccgcgacctcgggggcgggcctgtaggcgggcaactgcctgaaggacaagcgctgtagcacaaaaaaggccgcggtaggtgcacacaaccgacacctcggcggggaactggccacgaggtgtgagacaattc

SEQ ID NO: 380426 - DNA, 7299 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380427 - DNA, 1552 bp, Homo sapiens
tagccttggacaggcttctttgaggctccccgccgcagaaggctgttccctagcttcttgggtgtgttgaggatgctgaaggccatcgactggcgccggtcagcctgtttagtagaagctggagctgctttcttatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380428 - DNA, 6744 bp, Homo sapiens
  misc_feature (6703)..(6703): n is a, c, g, or t
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaagcaagcataagggccagtaccagtgngtgcctcacctgttctcttcgggatccttagagtcggcctt

SEQ ID NO: 380429 - DNA, 6917 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380430 - DNA, 6689 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggctcccacatgcatgaccccttcgcgcattgcaccaccagcagcgcgcactctccgccattgtcacctcgaccaggcaagcaagcataaggcagtacatgatgcccactatccgatggacta

SEQ ID NO: 380431 - DNA, 7684 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcctgagtggggggcgttcctattcactgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaaggtcaggctgctgggacaggggctgcagggcagcaattcccacttcctctcaagggcatctttgcactgggcactcagtcaggagcagggagggatgagcagccagtccatgttacagtgggaaagctgagaggtcttaaaaagggcagtgacttggttaagggcacttctgaagaaaaaggcagggctaggattagatccctgcctcctgactaaggctagcattctctccatgcgtagcactgagcctgtgcagggtgaagggagagaacgtggcgaagctgcagcccatcctgtgcctcccagcatgccccatgcagctgagaggcattgttgctgcccagtggactgcctgacaggctacaggcccttgcctttgtttccacatcttgaaggggaggtttgggaggaggggagaggggcccctggtacagcaggggggacctgtgtgtttagggtgccccctgctaccaagaagttggggaagttctggaacatggtaagggccctggaagtttggactgagggacagcagaggctgtgggatgagcctgactagtcaggagacatggggcctagccccagctctgatacttcctagcagtgtgatttggggctagtcactttatttctttgcacttcatctccaaaatgggccgataaacactct

SEQ ID NO: 380432 - DNA, 6513 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcactcttagccagagttaagggcccgggattcccagcacaattgtgacacttagctgtggggagtcctccatgcccttctcaggcggtgatgggctgc

SEQ ID NO: 380433 - DNA, 6151 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggtaagaatttggctggcagactcacctcactcctattccactggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgaagtactgagttgacttgatcggtgtgggaaaaagaggaatatagg

SEQ ID NO: 380434 - DNA, 328 bp, Homo sapiens
agtcgacctgctgctacctatcactgcaatctaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380435 - DNA, 2147 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaaggtaaccctctgctggggtcacagccacagtcttgaccacatgtgcaaagctgagtccagtttaccactgtgctcttctgggcctttgggtattaagttgctttctcttcaaggttcaatagtgtgctgtaattgaaagattgtgggcttcagtctagtacaccttttttttttaacttattttttttttccccagtcaatgccctcactttatagtacacctttcaatcctatctctgctgttcacaagatgtggatcttggacaagttaatcagtctgtttttctaagcatcctttccctaaaatgggagtagtaacgagtagctgcctcatcacctattatgagaaaacgtatgtaaagcacttcacacatcgtgtagtgtaaagtaagctctcagtgaaccagttgtgattgttactattggtaagaacccaatttggccacttactaataaccatgtagcccttgatcaaggcacttagcatctgcttcaggttcttgctctgtaagaggaatggtagtagctgcctcccacataagctgggtgtggtgatgcatgcctgtagtcccagctactcgggaggctgagacagaagaagctctcgaatctgggaggtggaggttgcagtaagccaagatctcgccactgcactccagcctaggcgatagagcgagactctgtctc

SEQ ID NO: 380436 - DNA, 1265 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgactctttcctgctggcttcaggtttgatgatccttacattctggaattcctctgtcagtctcctctgtaaccgacggctttgacttccagcccaggttttacaaaggaatgtccccccagcttgcaggatgtctggggtcacgctgagaaggcgtcccccacaggctgatgagcctgtcatgatcgagtcccgaacctgtggcattggcgccatgtcgctcagtatcacatctgctctcatgaccct

SEQ ID NO: 380437 - DNA, 602 bp, Homo sapiens
aggcccactctagaggttcccctgctcatccctcctatccctccttggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcgtaaatttgtgctggaccagagcgactgacagcccagagcgactacaggcccagagcgactg

SEQ ID NO: 380438 - DNA, 335 bp, Homo sapiens
gccattggtgccacccctcgagccaagggcaaggtagaggcactggcaggatgggggagggaaacccgatgagagcatgggcaccccccagaccgccccaccaagtagcatccaagatggggccacgccaggctgctggagggtgtggggtaagaggtgtccctgtcctggtagctcctctccaaggagagaagacagatggccccattctcatggagagcacccagagctgctcaggcacagccagcaactgataaccctggggctcacaagggaggggatccagacaggggcgtgggagcaggaagagatcttcccagccagtgggtgcaggc

SEQ ID NO: 380439 - DNA, 617 bp, Homo sapiens
ctgtctctgcaggctcagggtagacgcaagaacagttggccctggcaacatctatgtgttaggttgcctcattcaggccctgccaagcagcctgggcagcaggctgttccgtaattggaggccagagaaagggcctgagtttattctaggaacactggggatcctggtctgggaaaccccatgatgggtggacatccaggatgaacatccaggggaagtcctcctgagtcttctgtcctcctcttccctccccaggtggaagaactgagtaagaaactggctgactctgaccaagccagcaaggtgcagcagcagaagctgaaggtggggcagctgggggaatgggtctggcctctggacaagggagggaagctattctctaagctctggggccgtggggggtgtcggggcagaagaggggcaccctgcattccaggtagccctcctaggaagcctgtggcttagaagcccctgcatgtgtcttctgggagctctcgagagacaaccagggtggttcccatctctcaactgtcactgtccacttcagcagctactagtcacgtgtggttattgaaatttattaaagtaaatccagttcttcaatcacactagctaca

SEQ ID NO: 380440 - DNA, 7409 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggagtctggagtgcaatggcacgatctcggctcactgcaacctccacctcccaggttcaagcgattctcctgcctcagcctcccaagtagctgggattacaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380441 - DNA, 7353 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380442 - DNA, 3784 bp, Homo sapiens
  misc_feature (5)..(6): n is a, c, g, or t
ggcannagggtgctggagaggccgctgcgagcggaaggcctcctccataaccgagtccgaaagggcagaatctatgggggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380443 - DNA, 6926 bp, Homo sapiens
ctgtagtcagctcttggcctgtagtcgctcttggcctgtcagtcgcctatgggtacacgtgggtcccccggcacagaatccggccccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380444 - DNA, 8563 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcctgagtggggggcgttcctattcactgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380445 - DNA, 3867 bp, Homo sapiens
ttgggccaacgcaccgtgttgggccaacgcaccgtgttgggcctttttgcctatttcctgctgtgtgagatattcttctagtctttgcaggccttcctgggaagacagatcaacaaaacagcccagaaattcccagtattcaacccagggataccccagctcatgagctagctccctgtaagaaacacaacacaattataccagctgtacggtgcgatggccccacgttgggccaacgcaccgtgcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380446 - DNA, 8509 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatttattcttagagaagaataaagaaaaacgggtattataccagatatctatttagggcacagttggaataaaaagcaagtggtcaagaaaggcttcgtggaagctatcgctcctgctgagtcttgaaagcatccataggtgtgtgtgccaggttgacgagaagagcagtgtgaacagaggctgtgaaagagcctgactaagctgagatgtgaggccaggaaggcccattggagaccggctattaagacttgatcctaaaggcattgaggaaaccttggtggctgtaattgaaaggtttaggagaaaaaaaaaggaaccttggaagaatttgaaactgaagagtacatggttaatttgcatcttaaaaagattattctaatagctagtatagaagttaagactggaaaaatgtttttattaaacacttacatttacttattttgtgctagacataaagcactcatgacaattatacctgatttgtcccccaacaaccctctgaggtaggtttattctgtctcctttaacagatgaatctggggcatagaggggcagtcacttgcccaaggttccccagtggtagagctggggtttgaccctgggcagcctggcctgagttcttggcttgtcaccactcatcttcctctgtcagtgccatgatgagtctaggtgagaggagatgaagcagaccagggaaaggacatgagcatggagtggggtgtggttagttgctgttcaggaagcttggtgattgggctcgccaagcaggacgacattggattatgcccacgttcatggcttgggggcctgagtggggggcgttcctattcactgaaatgggagatgcaggaggaagaacagagaagtgggcttagattgggacgtgtttgctgtgaagcagccatgggcatctggtggggatgggacatctgggtctgggcattgccactatgaggagctattaggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctggacaaaatgccttctagcgtgaaggactgtacctcagcaggtttcctttccatagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccagaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380447 - DNA, 7398 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtgaagtactgagttgacttgatcggtgtgggaaaaagaggaatatagg

SEQ ID NO: 380448 - DNA, 1582 bp, Homo sapiens
tcggcaccgacttgcagtggtggggacgtggatcacggtgagtgtgttggcctgggaatgcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380449 - DNA, 1425 bp, Homo sapiens
gagaaataggcaattaagaggctgtccagcttgcctggggatcgctgctatcactcgcagttctgctcaacggtccctcgccgtagatgtccagagaggcccctccgaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgccgtcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380450 - DNA, 6081 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380451 - DNA, 6106 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggtaagaatttggctggcagactcacctcactcctattccactggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctgtgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtga

SEQ ID NO: 380452 - DNA, 1402 bp, Homo sapiens
ctttgccttcaagtacaggccggggtccggaagcggtgataccccttctctttcccagtggccctcaaacttccttttcccgggtccttaagcgggccccgccgacagaggccaatcagagggcagcgcgagggggcggggccatagtttaaactaattgtgcgctcacagcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctcgcccctgagttagcagctcgcccctgagttagcagctcgcccctgagtt

SEQ ID NO: 380453 - DNA, 490 bp, Homo sapiens
gatttggggctagtcactttatttctttgcacttcatctccaaaatgggccgataaacactctgcattccctacctcaaagcattatgaatagactccatgaaaaaaatgcgtagaagagtcttgacaacatcagcaccaccttgtgagggcttctgtcgacaaggcccatttcttgcagacacacactttaaggacctttgcaaagcagttgggaatacatggatgtgccgtgggatctgagggcttcggaagggaatgggaagcttctgtacagtgccagggactgtacactgcaacagattcactctgtcttccagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgcccc

SEQ ID NO: 380454 - DNA, 333 bp, Homo sapiens
aaaccagaatgtcaaaggggtatcgccattccactacatattgcagtattaatcacagtagccaatgtatggaatcaacctaaagaatgtttttaatgacaaacaaccaggaacacattttgttaatctaatgtgctccaacttactacacaggttgaccttgcataaaagtaactttacaagaatattagcactaaataattcctaacatcttggagacaattttcaaaataatgcgtttgtttactcattcaagatgtatttactgagctaccactgttatatgccaagtgatgttctaggtcctagacatgtagcaaaaaccaaactgaa

SEQ ID NO: 380455 - DNA, 713 bp, Homo sapiens
aaatctttgttttttttttccaacttaaaaatgctgagggttttgtgtgtgtgtgtgtgagctagagggagaaaaataagtgacatgacatttaaataccatattaatatttgggtcagttgtgtttaagagtaaacatacgactaaccgctttctaggaaggcttaatcttccttttaaatattgttctcaaaagatgagcaatatttatgtattgaaacaacattttcttgaagtatgaaaattgaggtactgaaaacaggtatgtattcaagaagatgtgccttgctttaccaaaaaaatgtgcttttgaaaagttttgctgtgaactgattcatgttttgaaatgcttcccatctggtgtcatagaaaagttgaaaaggaggcaaggattttttttctccccaggggaggggtggtgattttatgtgataaatgtctgtagtgccgagtcttccacgtacttttccccacgctttttcttttttttgttttaaggtccatgctaatctctgtatattccaattttagtatatgtgccgctgaagcaagcactcccgtgcttttttacttgctgcagtaactggtgagttgaccaaagtcatgttgttagcaaaggctgctgtggttttcagcacaaagtgaaagacaggcattcctctgttttggttttaccagttgtattagtctgttcttgcattgctgactggatt

SEQ ID NO: 380456 - DNA, 226 bp, Homo sapiens
tcacccaaagaaatccactgataatatttagtcttctcaaaaatctcttccctgtttttggttactgggatcattattgtctgaatctttcaaagtagaaatctgggtctcatatgtcattaaatttaagaagttctgctatttctgtgtcactctcagtgggacaacaagacattatgtgtgtcctaatgtaatggattaggaaagtacatgtatcacctatgga

SEQ ID NO: 380457 - DNA, 1349 bp, Homo sapiens
ttttattgtgtttttggtgtcatatctaaggcataattgccaaacccaaggtcacaaagagttacacctatcttgtcttctaagaggtttatagttttaactcttacatttaggttcatgattcattttgagttcctttttgtgtatggtgtgaggtagggggccaactacatttttctcctgtgggtatgcaggtgtcccagcaccatttgttgacataaataggatcttaaaggacacctggagccctttaaaacccaccacctggggagcaggaggtaggtggagcacctagcgtggggcctggcctggggaaagtgctcttggaaaatgccctttcctgctggaagagcaccagtgagcagctccccagcccctgcttctcagccttttgtgttgatattgtacaattctgtgtgtgtgtaacttgctgttcactagacccagaatggtgcttgctatggtttgaatatttgtcctctccaaatcttgggttgaaatctatctatctatctatctatctatctatctatctatctatctgtctgtctgttgttttagagatagggtctcactctgtcacccaggctggaatgcagtgggtgcactccagctcactgcagccttgaatgctggggctcaagccatcttcccgcttcagccttccgaagtgttgggattacaggcatgagccatggtgcctgcctggcctcctcaggttgaaatttgatcccagtgttgggggtgtggcctaatgggaggtgtttgggtcatgaggacggatccctcatgaatagattaatgtcctccctggcgagtgagtacatcctcactgtaatagttcctgtgagagctgattgtttaagagcttggcacctggcacctccccccactgtcttgcttcctctctcaccatgtgatatctgcctatgccgactcgcttctgccttccaccatgagcagaagcagcctgaggcctcagcagatgctcagacatcagaatcgtgagccaaataaaccttttccctgatcaatcatccagcttcaggtattcctttataacaacacaaaacagactaagacagtgctgtatgcagctgcatgctaaataattgattcaggtgatggtgaaggtcagaacaggaggatgtgggcttacatcatagcaggggagtgtccctggctgagagacctgcaggaaccaacagcagagaggttatcaactcttgttctacctggagaggtatttgagggcccctaggtccagctgatggggctcttggaagctgttgatcaagccagggaaaagatgatagtgacagccaagaccagaggtgatgaatgtttag

SEQ ID NO: 380458 - DNA, 1556 bp, Homo sapiens
cggcaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctagcaccaggatggacgtggtgcacctccaggagcagttagacttaaagctgcagcagcggcaggccagggaaacaggcatctgccctgtccgcagggaactctactcacagtgttttgatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagc

SEQ ID NO: 380459 - DNA, 1002 bp, Homo sapiens
tagagaaagaaaggtgggcccaggggaccggcactcagcatacggaggacccgcaccggcactggtctctgagtttcctcagtatttattgattactattttcactatctcagcaagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagc

SEQ ID NO: 380460 - DNA, 1219 bp, Homo sapiens
accgttaaagtgcactcttctatatctccaggagcagttagacttaaagctgcagcagcggcaggccagggaaacaggcatctgccctgtccgcagggaactctactcacagtgttttgatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagc

SEQ ID NO: 380461 - DNA, 447 bp, Homo sapiens
tgagaagcgggagagcgagaggcggcaggtggaggagaagaagcacaatgaggagattcagttcctgaagcgaacaaatcagcagctgaaggtaatcaacgcgcagggtggggtggaggtgccccctgccctgcgacccagccccacaggccaggcattcggttccttttccatggcttttaaatgtttgtccacatgcactgccaaaggataaaggaagctgactttggtggtgggagaaggggagggctccagagggggtctctactctcaactccaaatctctgaggcgcctcagcctggctctccagtggaggattcttctccctggaaaaaagttgcccatcctcaaggaagaggtggatatggcaaaaagtggaactccattcccctggaagctggtatgttggagcctttctggagggggctgggctccaggtggcttgc

SEQ ID NO: 380462 - DNA, 573 bp, Homo sapiens
cggcaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaaggtaagaaagtaggagcagtggctgggagaaggcctaagcttttacatcgtggattttgggagtgtggggggaggcactctgcctctgttcctggctggggtttcctcccagtatcacagagctcctagaacttacatatggctggatcctggcagggtggtgggagacctcttctcaatctaccctcatttcctgcatgctgtcacccaatctcatggctttagataccacctatgtgctgatggctcccaaatgtgtatttccagccctgtcttctccactaaact

SEQ ID NO: 380463 - DNA, 1386 bp, Homo sapiens
cggcaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagc

SEQ ID NO: 380464 - DNA, 311 bp, Homo sapiens
ccaaagtgctgggattacaggcctgagccactgtacctggcctgacctttgatttttgtatagagcatagtgcattttatgtagagaataatgaattccagagagatttctgaaaatagctagttagatggagttaattgaaaatatgttgctttgatcatcgttctaaaaatattaatgactttgaatgaattttttgcttaacttagttgttctatgatcaagtagtgaacttgagcactattctatttattttgcacatttttaggtttttagtaaacctattctatgtccattaagccacttttatt

SEQ ID NO: 380465 - DNA, 3316 bp, Homo sapiens
  misc_feature (2324)..(2324): n is a, c, g, or t
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctagggagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggattcccactgctggcaggagaaggcccattttcacagtccacagaagcgtgttaggctggggntgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttataaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaa

SEQ ID NO: 380466 - DNA, 858 bp, Homo sapiens
gtaagaagtgcttttcacctccccccatgattccgaggcctccccagccacatggaactaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtccaaaggcatataagatatggcatgtgctctggagagaactcatcatctatccagaacctactcatcacttttggaacgagaagagaactagcttctatggaggacttaccatgtgccgattgtggtgtgagacatagtacgagtgttactcatttacgtctcatggccaacctcc

SEQ ID NO: 380467 - DNA, 1717 bp, Homo sapiens
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctagggagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctagaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaacttaatatgcacagccgttcacatccagggcacagaggcagcctggctttccctggaggcccacggggaccacaatgctgcatttgtctgtggaactgagatttagctgcacattcttgcctgaatgcagcgggcctccagccacagcctgctggcatgggggattccaggagggatgtgcttcatgagccggcaattgcccttctttccagtccccagacccagtcaagattacagatagatgcgttcatcgcgcgcaggtgctggggaagccagtgggacatcactggctacattcaccaacaggattttccaactgcagtatttatcggtttttcaaacgaattcaacatctgtattcctcacccatttactgagtggctacaatgtgtaaggaaatattctcagtcatggggagttagaaaaggtccaaaggcatataagatatggcatgtgctctggagagaactcatcatctatccagaacctactcatcacttttggaacgagaagagaactagcttctatggaggacttaccatgtgccgattgtggtgtgagacatagtacgagtgttactcatttacgtctcatggccaacctcc

SEQ ID NO: 380468 - DNA, 2626 bp, Homo sapiens
  misc_feature (1634)..(1634): n is a, c, g, or t
acttcataaagactctatgtggaggatagatgctaccgtggccgggctctcagccacgttcttctgcagtatgcagtagggaagggcacatttctcacatgccttcaccagattatagttttctgggagcaaagccaagtgctcccacctttgggtgctgacccaagaagagatattctgtgaacttctgctctttggttgggcaatctccgagagtcagttggttgggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggatgtccacagagagggaagggccgaggggagagggtgaccatggggaatgtggggatcagggaggtggagggacagtgtgaataaatggcatctaggaaggtaaactccaatcccggtgaccgaccccaaaccagactgttggtgggctgagctcctagcctggaagcattcaggagagcctgccattcctgggatgatccctgctgggtatttgcacgagagtggtttggtttagctgcctctgctgccctttactgtgacaagcaaggaggggttgcttccctccctacctcatccatcccacacaccttggccttctgcaagccaagtggttctgcaaggtcaaggcactagtatcagatggcaagctcagtgcccgggattcccactgctggcaggagaaggcccattttcacagtccacagaagcgtgttaggctggggntgggggtgggatgggctggtgagaaagttcaaattccaggaagccactttttattggatataaggtatctaacggcaaaagtacttagtagcaaagtggccaccttttgattgattgggcttcctcataggaagcactgagggtgtgtctttgtacttggttcattgcccttcacctggtagagaaagagaggtcagaaatagcaagcaaaaagcaggactcccaggagccacaagaaaagagcacaggctgcaccaaagcaggggcagcagagaataaaatatccctttgaacttgtcaacaattaaaaaactgcaaggagtcaccttataacactatttccagtaaaggtggaattgagtatcagagggattactgcggtgttaaggtagccctgccacgtggctctccaggcagggccaagaagacagcacaaagtatgggtttggccataagctcatatgctgcccccaaagactggggagagctgtgtgcctcagtgttgcagtgtgaattcctaaatagagggtaaagtgagcctagccaggaggtgtttggggctctatcgcgcatctctcctaccaagctgggcaagagcttttaggagattcatccagctttgtggatttagaaaggaagccttcagttccaatcagaatcctctttccttataaaaaaaaaaaaaaaaaaaaaaaaaaaaggattttccttagctccagcatttgctttcaggattctgacacctgagaatttgggggtaggtactaaacgaaacaaaacaaaaggacaacaaggaacattatttctagtgtttctaaaatgggggtttagaaccccttaaggggccatacttaggcttgaaaaggctaatgttggaaaaaacatgttcttctaattggtctgctgtctgtcttgtccttgcacactctgcttacagagttttgttagagatgctgaactgcaggctgggagcaggcagtgccaaaagggaa

SEQ ID NO: 380469 - DNA, 1169 bp, Homo sapiens
gagcgaacatggcagcagaatgaggaggctggcgccgggtcgtggccgccgctgccgcgctgcagctcgggatcccagtccggcgcgctccgggccgcatccttagccggcctcctggcggccgcgggattatttcattcccaacggagagctagggagaaaggagactcccccgcggagcggttccgtgctctggcagggtgtagacgtttgtctgtgcgattcgccggctgcgcaaacgacgcgggagagagccggtcccgggctgcggcggcgcggccgcggggatgagccggccatggagcggccttggcggggcgcacgcagcggactggcgctgccgcgggagcgcagcctgagccggggctccagggggcttcgaagcctccggcgccctgggggggtccctgccgccgactccgggaaggacgcgagccccgcgtggcggacactgccgcagtcaccgttctgaggcgccccgagcttgctccgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagccatgcttcccggggtgggcgtgttcggcaccagcctcacggcccgtgtcatcatcccgctgctgaaagacgagggcttcgcggtgaaggcgctgtggggccgcacgcaggaagaagcggaggagctggccaaggagatgagtgtccccttctacactagccgcattgatgaggtgctgctgcatcaggacgtggacttggtgtgcattaacctgccgccgcccctcaccagacagatcgctgtcaaaaccctagatgtcatcttgcagtttagtaggaccagagctccatgggggcaggtacctgggtggaatctctcctgcctgtcctgtcttgagatacctacacggaaggctggcacacgcccgagattagactgtcaacctcacaccggacacacacctcctctgctggccccagtattggatggcagtggttgccaagcaaccaggttatctgcactctcccggttactgagcagatacagaagacaggcctgcaactct

SEQ ID NO: 380470 - DNA, 1128 bp, Homo sapiens
ctacaagtcccagcgggctgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggca

SEQ ID NO: 380471 - DNA, 2276 bp, Homo sapiens
ctacaagtcccagcgggctgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataac

SEQ ID NO: 380472 - DNA, 1923 bp, Homo sapiens
aaggtactgaggctgggtgtttcgtgcggggtggggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggcaaaaaagaactttgccgagaaaattgtgtacctgccagaaccaggagaagtgtgttcctgtttcttcacgagcagactcgcatcacaaagcatgaatgttaacccacagaatccaaggagcatggctggcccgtggggcaggtggagggagcagtcttcgttcttcctcccctcagtggcagtttggtcttcacctgtttttaagctaccttaaacgcacttttccttcctgcacagctaacttctacatcactgaaatgcccattccttcctccgtcccacctccagccgaatagaaggtctgctcccggatcaccctcagccttggtgctcagtggtcccgaggccctagacccccaccccccgccagttgctttgtctggtagctcaagagaaggcagagccccagcacctctgtgccccccagagctctgtgcagggagttggccagctgccgcatcatcggccaccaagggcacaagaggcggaggctccagtccctgctgggctgcctcagtcttcagtgctgattgtgtcacgggtcagcgtgcgctgctgagccctgtactgttaacagtgcaaagctagtgagtagctgtcaggttccctgggcctgccatcagggatcactaaatttaaggcttccagatccctggcaggaacagattccagtcctgcttactcagtacatttgctccaaacttttcaacttgagggcaatactaaacttaaaaataagagtttttttattacaaaattatttttatggtccctttaacgaggaccctatggcaaatgcacaattattcagaattacattttatcgttttcacattgaaaacagcaaatgttgacttagtaatttttatatcgatatctatatgtatatgtatatttaatcaaccagcagttttgaaactagtcatcctggtacaaaagttttgcagcattgcctaaattatagtgctcaacacaagaactgtttttggggccagtttagcatttgtgccgcctccttttgctactcaaaacagcaatgcttggcggcagccttccatgaggcagaaggggtcgtcgttctctgaaaacagtgactctgaaatgttgggacaggggaaggggtgggaaacatgaacatgctcaaataac

SEQ ID NO: 380473 - DNA, 1185 bp, Homo sapiens
ctacaagtcccagcgggctgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggaacattggaagatatctggatctgcagactctgctagactggactgaaacattttggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggca

SEQ ID NO: 380474 - DNA, 440 bp, Homo sapiens
taatcagcaaaaaacaccctttcttaacttgccccagtgtttccgatcaacatcttcatctgcatcccacttgcgagttaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtatcagtccctcaatctaacccatgttcctgaacacagtgcacccatctatgaattccggtgacaacggttcagaacagcaaccaaataaaactgaacttggca

SEQ ID NO: 380475 - DNA, 1231 bp, Homo sapiens
ctacaagtcccagcgggctgctcgcgcaccgcgccacgtgttttctcctcccgccaatgggcggaagcgccgcctgagcctgctcccgccccccaggctcgcctgagccaatcggaaggggcggggtgtgtgtgtgtctgtgtgtgtttgtgtgttgtgtgtctgtgagtgtctgtgtgtgtgtatgtgtgcgcgagggcaagtcgggagggggacccagctcaggactgggaggccctgctcgcaggtccctgggtcccggtggcggccggagcgcttgctccgcaggcagcgggcgggtggtcgcccctcccgcccccaccccgcgcgtgcgcgccccggcctctccctccccgccaccctcctcggctcccgcgcggcggcggcggttcctctcccactccccccagccctggctccgggggaccccgcgatgccggtccgcaccgagtgtcccccgccggccggtgcctccgctgcctccgcggcctcactcatcccgccgccgcccatcaacacccagcagcccggcgtggccaccagcctgctctacagcggctccaagttccgcggccaccagaagagcaaggggaactcgtacgacgtagaggtggtgctgcagcacgtggacacgggaaactcttacctttgtgggtacttgaagattaaaggccttactgaggagtatccaacccttacaaccttcttcgaaggagaaataatcagcaaaaaacaccctttcttaactcgcaagtgggatgcagatgaagatgttgatcggaaacactggggcaagtttctggctttttatcagtatgcaaaatcatttaactcagatgactttgattatgaagagctgaagaatggagactacgtcttcatgaggtggaaggaacagtttctggtcccagatcacacgatcaaagacatcagtggtgcttcttttgccgggttctactacatctgctttcagaagtcagcagcctccatagagggctactactaccataggagttcagaatggtgaggacctctgaggacagaggccacggggagggcttgctgcccagctggctctcccttggctcatcaaacccaaaagcaacatcttagcctgtctctgtatagattctgtgctttatttggatgctgagagcttatttcagtgatctcagttgctcacaataaggccttatccctatgcacagagcagagtaaatgagatgaaaat

SEQ ID NO: 380476 - DNA, 5193 bp, Homo sapiens
tgggaatccaactgaagagcagccagaggagagctgaagagaggagggggaggccgatgacctgggctctgggcctctgaaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggagggcaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggca

SEQ ID NO: 380477 - DNA, 601 bp, Homo sapiens
ggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttagcgttggtctctctaccaagggctttactgccacccctcatttcctgtcttactttttca

SEQ ID NO: 380478 - DNA, 357 bp, Homo sapiens
ttcaacatcagtctcactgcatatgtctctgcatgggatgacataattggaagagactcaaagccccatttcattctctctccctagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacag

SEQ ID NO: 380479 - DNA, 5821 bp, Homo sapiens
tgggaatccaactgaagagcagccagaggagagctgaagagaggagggggaggccgatgacctgggctctgggcctctgaaggtctggcgtattctgacaggacacagtgagcatctgtagaggagaggcttgaaataaaggaggagcacgaatattccctggatttctggaggcctgctttaaggctggccagttctgcaagaaaggcaaggaggaggagactggctcacacctctggaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggagggcaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttggcagaaatcacccttcttcttgaaattaaaatacagacccaatgataacacatgaacacacatagagataattaatatatgaataatatgttcctttcaaaagtttttttctcagctttaaacgcaaaaattaccaggggctgctatgtagggcatacttcagagaaaaagtagctacttcggttggactctgaagtttgggaaagatattggtggtgtaaaaaaaaaaaaaagcatggagttaggaaaaattttcctatgggagtgaggtatcctgtttgcctagagtgagtgagaggaatatattgagcaacatagaggatgacataagttttaaagagctgaggatttgcattttacagctcaaagtacaactgctgcttccatactacctaaagggcaaaagaataagacaggaaagcatagggatttgattgagtcaggaagacaatttaatcatgatggtaccatggtaagtgttaaggcaacatcatacagccattaaacatgatgatgtatagggttttaggaaaagccctgacatttttgatatttcatataatagagaacactggtgtcatacatgggaagtatgatcccatttgaaaaataaatgtgaataaattgacca

SEQ ID NO: 380480 - DNA, 417 bp, Homo sapiens
aggcgcggtggcacggctgtagtcccacctactcgggaggctgagtcaggagaatcactggaacctggtaagcagaggttgcagtgagccaagatcacgccactgcactccagcttgggtgacagagtaagactgtctcaaaaataaaataaaataaaaggctcctattgttcctaacttaggagcagggatcaggcctatcattctagcatcatctaacaaagttccacaaacagagcaaccagatatccaagatctttgatcttaatatcaaattcatatattgtcttttttctataaaactttgaaatgtctcagaaatcccagtattttggcattcacactactgtcctggggtcttattcagtggtttagagaccactcgcatatgtgtatacagtatttctcaatgaatcc

SEQ ID NO: 380481 - DNA, 385 bp, Homo sapiens
ggccctctctcccacagtggaatggtgcctggaagcagccatgtggccagggggaggtgggagagcccctgaggggagggagatgtgggctggagttgtgtctctgtccttcagatccctctcagaatcccacaaaaagaatgttttcagcagatgataaaactgactgtttttagtgcagcaactcatatgatggtccagcttgctaaacatcacacttgtattgtcattttttcctattttttctaggtttgggatatagtgtcacacacttgtgttatttttacatgtcaagatgatggcattcatagaacaatgcatttgcttctaaatttggagtataattttaaactaagacaataaagtcaatctgttttgtatcaca

SEQ ID NO: 380482 - DNA, 446 bp, Homo sapiens
gagaaattgatttcctctcccaaagagctaactttgccatttctgcatgcaaatgtgccctaagagtacctgcaaacaaagttgtaatttttccctgaaactcatgtttggttcttttcaaatgagtggttgttgcccttgagctctgcacatgctttatgtcaatccagaaatgtggcaggttttttcttttttttgtttgtttgttttgttttgttttgttttgagatggaatcttgctctgtcacacaggctggagtgcagtggcgcgatcttggctcactgcaagctccgccttccgggttcacgccgtctctactaaaaatacaaaaatcacccgggtgtggtggcaggcactgtagtccagctacccgggaggctgaggcaggagaatcacttgaacctgggaggtggaggttgcggtgagctgagatcacaccactgta

SEQ ID NO: 380483 - DNA, 253 bp, Homo sapiens
ggaataaaggagacccattttaaaagggggtcagaaaaggcctttctgcaaaaatgacatttaaactgagacctaaaaactgagaaggagccgggcgtggtggctcacgcctgtaatcctagcactttgggaggctgaggcgggcggatcacaaggtcaagagatcgagaccatcctggctaacatggtgaaaccccatctctactaaaaatacaaaaaattagccgggtgtggtggcgggcacctgtagttc

SEQ ID NO: 380484 - DNA, 480 bp, Homo sapiens
ccatacatactctgtacatgtataatttctcataacatttggaaccaggtggtgtttttgagggaatttaaaagaaatgaaacgttaagatagtttagcgacaaatgaactcatggagataggaagtagaatgatggtcagcagaggctgggaaaggtagtgggggcgggaatgggggggaagatgaggtggttaatgggtacaaaattagaaagaatgagtaagatgtctgccgggcgcggtggcttacacctgtaatcccagcactttgggaggccaaggcgggtggatcccttgaggttaggagttacagaccagcctgaccaatgtggtgaaaccctgcctctactaaaaacacaaaaattagctgggcgtggtggctggcacctgtaatcctagctactcgggaggctgaggcaggagaattgcttgaacccaggaggtggaagttgcgtgagctgagatcacgtcgctgcactc

SEQ ID NO: 380485 - DNA, 315 bp, Homo sapiens
cttgaagccatccagcctgaaaaggaaagtgttgatttcttgcctaccctgtctcagccagacgcagcagaattaggaggctccagggcaacatcaccgcttctctcctgtgggcatgtttctagcagaagtattctgacacatctatgcaagcatttgacaaggaggttgtgaaatgggaggtccagagggctgtgcctttaaactaagcccctggggggtgttaaaatggtcccaacctgccccaaagagcgcataataaaattttctcatcagattttggttctcacgcaccatacttaggtttgcacttcc

SEQ ID NO: 380486 - DNA, 1061 bp, Homo sapiens
  misc_feature (1)..(1): n is a, c, g, or t
  misc_feature (3)..(5): n is a, c, g, or t
  misc_feature (699)..(699): n is a, c, g, or t
ngnnnaagaaaccttaacattatctattcaaaataagttttttcagaaactgtgttgcacattggtgtacatctctttaaatagatttcaccttggcattcacactttgtctggctctgtgtgtgttagggttggggtagggggagcattgttaatgcccaaatcctttccaagtctcatcagtgaatagtctgggggaaggagggttgggaatgtgtatattgaacaaaatcctctaaatgattctgacttgcctctgggttgaaaatcaatttaacaatactatgtgttttctgaagtaaaagtcacacttaaagtaactggtgatcttggaaatttttaccaaggatactgactaatgagatggcctaccccaaatccagaatttaacttaaattccacctccccctgttttccttaaactaatctctcaccatattttccaaaaatgttatacttttcttctcatatgtactgcaatttgtcttgcattgtatttatctttgtgatttcagctagtatatggactcatggatgtctgatggggaggagggtggagaatctataagttttttcatctttctaatctttattatgctttagtcaatagtatatattcaataaatgctgaatgaattggattaaatataaaacattaaatgttatgaaaagtatgcttaattttcaaattatcaaatnattctctctattgaagggaaatcaatggtgtttttcaactttgaactgaaactctaaactatatgaaatcataacaatgtgaaattttaaacagtattattcttcataaaacagtaatataggctttaattcacaagaactgcaatggggtctcatcctttaagcagtcatttttaatgttctaaccaaatccttatactaaaacagaaacaactgctgaatgtgataaagtaatggaaaatatagaaaaactcccattttctctatctcattgtgtgtgaaatcattcttaaaaagaatcacttccacttctatttgaatcaaaaatagccaatagggcaattctaactggttaaaaaaaa

SEQ ID NO: 380487 - DNA, 257 bp, Homo sapiens
gctgggtgtggtggtacacctgtaatcccagctatttgggaggctgaggcagaagaattgcttgaacccgggagacagagtttgcagtgagctgagattgcaccactgcgcaccaacctgggtgacagagtgagatgcagtctaaaaaaaaacttattaaaaaaatatattatatatatggaaataaacaataattaggaaataagaatttcttatttgtgcttagaatacacagtgaagtaaacagaaaaaaaaaa

SEQ ID NO: 380488 - DNA, 5555 bp, Homo sapiens
gtgatgagatataatgcatcctccagtccatgcacgcttcctcttgcaatttgggcatcattcctcagtggaaacctttaaaccctgaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtatccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggataatgggacccctcccctccaaagccaagcggctgtgattgttactgttctggatgagaatgacaatagccccaagtttactcataatcattttcaattttttgtgtctgaggaatctgccaaagtatagtactgtggggggtaatcacagtgacagatgcagatgctgggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaacggttatccaccaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcacagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtggcaactaatgttaataagatttcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctgaaaaaaaa

SEQ ID NO: 380489 - DNA, 1148 bp, Homo sapiens
gtcgccagtcagtttcctctccgtggaaggctgagtcccaattccatagggctctgtgccagacttttagtctctgataactccgaaatccttccttctgtttcctaagctctacagtgtaactcacacagcaaaagtgacaatattcctgtcactcctcagaaatgtcccagctccacgggtttccacattcaggagaatgaagaaagccattacgagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctggtgagtccccttcaaaattttgattgcttggagttgttctggttttgtagtgcacttgagctttcaaaaataattgtagggggcaaggatgaacatttagttatttttttgctggctttattgttgttgctgtattctttgagatatacatttaatatgtttgatatgattttggctgttaaattgtatgatgtgtcttcattttatgaaccattaaaaaagaaaaaaacatgctataaatataactgaaagaagccatttgttgcaagatattctgatgtcagagatcttatgaaatttgaacacattttagaactgcaaaaatacagttaagtagaatagtcaatgaaaaaaagaaatctatttgcatatataaatgtcctatgaaatttgattttccagtgaacactttacaaaaacaaataaagaatattagagttaaaggtattttagaatttgtctatcagattttctggtttttaccagaaaatttaaaaaaaaaaggattaaatcatgattaaaacaagtgtgaagaggagagataacaatttgggggttgtttttcctttattgtctacttgaattcttggataatttgtttttttactactatgctgagggagatatatttggccaaaacttttattctccacagacccataccccactccagaaatcactgcccactccaaataagcattgttggggggtgttttccttggccttt

SEQ ID NO: 380490 - DNA, 5486 bp, Homo sapiens
gtgatgagatataatgcatcctccagtccatgcacgcttcctcttgcaatttgggcatcattcctcagtggaaacctttaaaccctgaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtatccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggataatgggacccctcccctccaaagccaagcggctgtgattgttactgttctggatgagaatgacaatagccccaagtttactcataatcattttcaattttttgtgtctgaggaatctgccaaagtatagtactgtggggggtaatcacagtgacagatgcagatgctgggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagaaatgtcccagctccacgggtttccacattcaggagaatgaagaaagccattacgagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgtttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagtaccattaagtgagagagtaatggaaaacggttatccaccaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcacagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtggcaactaatgttaataagatttcagttgcacgtgcaaacaaatccaaattcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctgaaaaaaaa

SEQ ID NO: 380491 - DNA, 4066 bp, Homo sapiens
gtgatgagatataatgcatcctccagtccatgcacgcttcctcttgcaatttgggcatcattcctcagtggaaacctttaaaccctgaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtatccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggataatgggacccctcccctccaaagccaagcggctgtgattgttactgttctggatgagaatgacaatagccccaagtttactcataatcattttcaattttttgtgtctgaggaatctgccaaagtatagtactgtggggggtaatcacagtgacagatgcagatgctgggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacaggtaaacgagcacttttactggtctataagtactgcatacaagtgcccagtcaaccagtattaacgtgccagtatgtctattgttttggtctaactttagcttagttagaaagaggtaaaaaaaaacttgaccccttttctattcctctggggctcagtcaagaatttttagaacagctttgaaatttctgagttctgagaatattttctcctttcagtttccttcaaatggcaaaagatgaaaagagaaaattattccaaaatgtcccaagataatgtttgctgaagaagaaaaaacctgtcctgatatgccaaattctgctcctgggggtttccaaattgactgcttcaagactttcaccttaccttttgatctaaaaagtcaccttcaaatctcaagttttcaatgacttttgaaggtgtgactgcaattatgttgcagctatggttgctaaaggggttaattttttttttagtctctaaacaggatagtagaatattaaatgtacatcagctgtgaagcacatgatcgttgatagattgcaactaagccatataggaagtcttctctttgatttcaaattattttattgtaatatattaaattcgatacttaatagaaagatttttagtgtccgcagtggccaaatactctttcaaaaaaaaaaaaaaaagaatgcttgctgcctaatataactgatttaaaaagaaaagaatgaatccattgtaaatattctctcatcttagtaatgcataagtgatctgtcataactcattttaaactgtgaaatatgccatatgaagagggattaagaggctgagaaactcatatttcaaccaaatccagaattagtttttcttaggtctaataattccttgttaataaagatttaaatgcagcgctgtctaa

SEQ ID NO: 380492 - DNA, 4017 bp, Homo sapiens
gtgatgagatataatgcatcctccagtccatgcacgcttcctcttgcaatttgggcatcattcctcagtggaaacctttaaaccctgaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtatccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggataatgggacccctcccctccaaagccaagcggctgtgattgttactgttctggatgagaatgacaatagccccaagtttactcataatcattttcaattttttgtgtctgaggaatctgccaaagtatagtactgtggggggtaatcacagtgacagatgcagatgctgggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagaaatgtcccagctccacgggtttccacattcaggagaatgaagaaagccattacgagccacaggacgaattctatgaccaggcctctccggacaagaggactgaagcagatggcaactctgatcccaactctggtgagtccccttcaaaattttgattgcttggagttgttctggttttgtagtgcacttgagctttcaaaaataattgtagggggcaaggatgaacatttagttatttttttgctggctttattgttgttgctgtattctttgagatatacatttaatatgtttgatatgattttggctgttaaattgtatgatgtgtcttcattttatgaaccattaaaaaagaaaaaaacatgctataaatataactgaaagaagccatttgttgcaagatattctgatgtcagagatcttatgaaatttgaacacattttagaactgcaaaaatacagttaagtagaatagtcaatgaaaaaaagaaatctatttgcatatataaatgtcctatgaaatttgattttccagtgaacactttacaaaaacaaataaagaatattagagttaaaggtattttagaatttgtctatcagattttctggtttttaccagaaaatttaaaaaaaaaaggattaaatcatgattaaaacaagtgtgaagaggagagataacaatttgggggttgtttttcctttattgtctacttgaattcttggataatttgtttttttactactatgctgagggagatatatttggccaaaacttttattctccacagacccataccccactccagaaatcactgcccactccaaataagcattgttggggggtgttttccttggccttt

SEQ ID NO: 380493 - DNA, 305 bp, Homo sapiens
cataatgatgaagtgaatgggtcgacttttaaatgctcatattatattggcttgtatagatatagtcatggtagtgttagccacaaatttatgttttcacactcatcattatcctaagaggtgaaaaaattgttttattcaaattatttaaactgtttattaagaaaataaagaattatattcctataacacattttaggagtgtaatgatcaataggaaagtataataccccgtcttgaaataacagtatagagttagtagattgtatatttattttatgtcttatatatattattttccagtt

SEQ ID NO: 380494 - DNA, 426 bp, Homo sapiens
gcttcaggtatggctctatccagggcctctctatctcatcttatcacagcttcatggagccgtagcttccatggagagagaagtggagtgatgggccagaggccattggcacgcgtggctttctgattggggcaccacctaaaccaagatttgccttctaaagtcgaagacttgctttctttcccactctcccagaggaaactaagaaaaaagtgaaatgtaagcactgctgccgaagctgcctttgccccacgaccaccgtctcgtcccagctcatacctcacggggtcagatagcttcagtcttccagcgagagaaatcctggtgccccaggcacctggggagaagctcacagttactgtggctattgtcgctgttggtttgaactttctaataaaactgtatctgtggccaggcgcagtggct

SEQ ID NO: 380495 - DNA, 268 bp, Homo sapiens
tgatcaagaaaatacctatcaatcagtcaacatttattttaaacactaacttacatgtaatattgatgaatggaaaaaagatattcaggtattttaaactatcccattcactagtaacatatatgtccctaccctgggctatctttctttaacgtcaagtatgtatttcttccttgaagaagcatcaacacaattgtaaataggaaaaaacatctcaagtattgtaaacatatattttaaagtaaagctatgaaatatgaaaatgctc

SEQ ID NO: 380496 - DNA, 224 bp, Homo sapiens
taattcatgaattttaaagttttgttgtgtgacatatacatactttacattatatttgtattgactattaatattttaatattgatatggttgtatttttatctaccattgctagttgatttctatttgtctttcttgcctcttttaatctgcactctttgccattttggattgtggttttttaatgaattcattctatctccaatgttaagttattattagtt

SEQ ID NO: 380497 - DNA, 2029 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380498 - DNA, 413 bp, Homo sapiens
gcacgaggcaaggacaaaaatgtaaatctacacaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380499 - DNA, 912 bp, Homo sapiens
  misc_feature (85)..(85): n is a, c, g, or t
aagtgatatggggaggagactgcgtttaaggtcaggcagggagttagtgttcatgtgtgtatacgatggacaggagagtgaacanggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccacctttttcattagatgtaaaacctgtaggtaggtcccaagccgaatcaattaaccaagccgtgggtagagatggacctgtcgtggagaccaatgtcgacgacaaggagagggggacacggggcaggatttacagggggctcttgtgtctttcccgtgata

SEQ ID NO: 380500 - DNA, 2071 bp, Homo sapiens
cgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380501 - DNA, 1987 bp, Homo sapiens
agagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380502 - DNA, 1982 bp, Homo sapiens
gagatgatctcctcctcctttttccaaggctgcacttcttggaagtgaagccggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380503 - DNA, 2067 bp, Homo sapiens
cgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380504 - DNA, 1968 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380505 - DNA, 2140 bp, Homo sapiens
cgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagttaagaaagaaaaacagaatccactgaaaataaaatttctatttgaaagtttcataagtgtaattgactaacgggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380506 - DNA, 1980 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380507 - DNA, 2018 bp, Homo sapiens
cgcggactctttgtgtgtctgagcgcggctccgcgccgccgcaggcaccattttctgcttcgctcaggacaggcacataaaaggaaggcggctgccgcccgtcgccgtcctcttttcctcagatgccctctgctgcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380508 - DNA, 1911 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaaggtaagatccttagatgccatattcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380509 - DNA, 1843 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatgtacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380510 - DNA, 1939 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380511 - DNA, 1919 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380512 - DNA, 1546 bp, Homo sapiens
agagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380513 - DNA, 962 bp, Homo sapiens
acgtattatagcattgatacgtattccttgggtctatctgttgtagcgctcgcgaactcagtagtaagccaggtaagagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380514 - DNA, 1105 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagtttttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380515 - DNA, 1095 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380516 - DNA, 1137 bp, Homo sapiens
cgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380517 - DNA, 1024 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380518 - DNA, 917 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacctttgggacaggaagtcttcccttaggaagccttccctccatgtccttgtttggaaatggttcttgactgacccagacaaagagttctgggtaataaaccattttgagaatcttagtcttgggcttctattctccctctcttcagtccagggagaccacagacaaagccccgctcctgttcactctctctcatcagtccgga

SEQ ID NO: 380519 - DNA, 792 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacccatgtgcatatgtaatatttgaggcaaagctgggaagtttcctttatttcgctttacaatattgtatctcatcatg

SEQ ID NO: 380520 - DNA, 754 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380521 - DNA, 2241 bp, Homo sapiens
  misc_feature (449)..(449): n is a, c, g, or t
cgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggtaagatccttagatgccatattgttaacactattttcaatatagaaacaattgttttaaaatatcagagctttttcatttgaatacccattataggctgctataacaatccattaatctgatnctatgatgaccttggaaataatgtacttttaaaaaatatcctaaagtcctatgacttaaagttcacattatcttccttcataaatgaaaaattttcatttaaaacatggaatcagtttatcaaagtacagtttacaggttttaagtctgttccatttctggttagacaaactcaaatacaatgatcaaactaaaagatttcttaaaagtatgatgactattaattgtctgctaatgaagtctgaaggtctgataagattatccatgaagcaaaagggaggaacaaaaaaactgttacatttctttcttctaatttttgagcctaaaaaccattttttataaacgtggtttcattgttctgacatcttaggtgtggcagttctctgcctcaagaaaatttgtaaaatttatattttagattttagcataatttctgaaacaaacaataacaactacttaccagtttttactgtagatactggactttgcctcttagggtgaatacttgtttgacttcaagcggggagagtatactttttaaccaatgacttgctgattttgcagttaagaaagaaaaacagaatccactgaaaataaaatttctatttgaaagtttcataagtgtaattgactaacggtgagtcctcccccagctgttactggtatttcaatgtttaagaaattattttatttacactaaatagtctcaacaattccctatcttatactggcaggcagaaactgaagaggttgtatcaactggcagtttgcactgaaagaaaacaatcttaaatcacttttaatcttgcagagcatttttgaaggtcaaggttgaaatcactggcaggaaagtaggtgaacaaaatggtttgaccctgcctgaactagacttgcactgatttgtagagctggagtggaagagagctaaaatagtagcgctttccttaaaagacacccacaccccaccacctcaccagcagcacaccagcggcagcagcagtataaccacagacattcgtcactgtgccagatcagggcataattctcttaaggcagctgaggccttcacattagttcttgcctcattcaggcatccagaggtcctctctctttgatactggtgacataaaccagaggggcaagactaggcatagttccttgatgagttcagtggtgcctcaccgtacccttagaaagccagccctgctgtgctaggtcttgtctcacacaaagacatgctcccaggggtgggcaccgtggatcatggtattcaggtcttctgctattttaagttctttcttctctaaatatgtgaataatattttaagcatagtgttatttgttctttttccagaagttcccttctggaaaagcatatctttgtataattgtaggaaaaataatcttgacttacttggtccaaagcacattattaactggggattaatttcctagtagtcatctgtcgggagggctgatccaccccgaggcacattaactggcgtgactttcaggacggcggggctgtgggagccactggacacatctgccccccaacccctagcctcttgaattactcaagtccctcagctctgttggcacaaatacgtgctggatgatagaagaaccgtttttcccatggatgaactttttttggcttgaattcttacaaggcctgacttctggatctggagaaagaagacttctttgtgtcccatcttcaaaatgcctcctccacttgttgcagaagcctaaaattcctttagttggggcagaaagcctattattattta

SEQ ID NO: 380522 - DNA, 764 bp, Homo sapiens
agagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggaaacttctctgtcccctttcatggagtcataacaatggaagaggttcaggagaaaggaatcagctccttgcaaggtttctgatactgtccttcctgaaatgaagagctcctctaccttaacccagcctgctaagactgctacagcaagattgacagctggtcagattgctgtcctcataaaagcatggtcatcaccttcagctgggctctcaaatggaacagccgggcaatctttgtttccctggtcagtttgtcttcccatttccatgtcaaaattcctgtcaaacttctgaatctctcacctatctcagcaaatgggaagtctccacatctctacacctacctgttctcatgctcctgtcctgcttcgctcctcacatttgacaaggagctcctcctcctatgaaaggccacttgtcccatagctttcttccatcccatcgtgtctcagcatctcagggatcttgcactgatcattgtcccattttcagagccggtccaagaggcagattacctgagcag

SEQ ID NO: 380523 - DNA, 982 bp, Homo sapiens
  misc_feature (11)..(11): n is a, c, g, or t
  misc_feature (64)..(64): n is a, c, g, or t
  misc_feature (76)..(76): n is a, c, g, or t
  misc_feature (117)..(117): n is a, c, g, or t
  misc_feature (153)..(153): n is a, c, g, or t
  misc_feature (200)..(200): n is a, c, g, or t
  misc_feature (323)..(323): n is a, c, g, or t
  misc_feature (372)..(372): n is a, c, g, or t
  misc_feature (433)..(433): n is a, c, g, or t
  misc_feature (513)..(513): n is a, c, g, or t
  misc_feature (515)..(515): n is a, c, g, or t
  misc_feature (519)..(519): n is a, c, g, or t
  misc_feature (563)..(563): n is a, c, g, or t
  misc_feature (639)..(639): n is a, c, g, or t
  misc_feature (668)..(668): n is a, c, g, or t
  misc_feature (709)..(709): n is a, c, g, or t
acagagccatnggaactggggccttccctgaacagtgatcatgccaggcctggacctttagccntgcctccccagnactccttagatccaactctttcaacaaacttctgtgatcancagccccctgcgggcaggggggttctccctccaccnactctcaaggctcctcagcctaagactatggctcatgagaaacactnaggcctgacctaggcttgggagtcaaactgctcatattgagcatattgttaagtgggtaaagccaagtaaaggtactgggtgtttttgtgaccacttgtgaatgggtgtatggagcactgaanagggtctctgcctgaaggctcctgtctgactattcccggatcccttatnactgccttctgagacttcctctttggggtacccttcatgtatgcccacgggggtgattgtnattcgtgagactgcagttgcttggagtacttctttgcccaaggaatcccacagaccccctcccgatagcacagtggctcngntctnacttgctcctgcttacgaagtattcccaatcactggtcctctgnccctacttggacactcctggacagtcatgttttttaaattcttcctttttatcaagtcagagggtatacttctatnatttttactcatggatgttaggaaatctngtcttcttccctgtgattgccctgttaagtatttaaccatngctttcatgtgtttcccaaatcttctctagattaaatttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380524 - DNA, 1942 bp, Homo sapiens
cccacgcgtacgcccacgcgtcgaggagagagagtgaacaggagcggggctttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380525 - DNA, 2831 bp, Homo sapiens
  misc_feature (449)..(449): n is a, c, g, or t
cgctttgtctccccggggcgccgcgcggtgcagtggggacggcgcggcgagcggggcgcccggggcgcgggtgcggggtgtcggggcgcgcgcgcctgttggccgctcgccgacggggcccagagccgccgattcctgccgagtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggtaagatccttagatgccatattgttaacactattttcaatatagaaacaattgttttaaaatatcagagctttttcatttgaatacccattataggctgctataacaatccattaatctgatnctatgatgaccttggaaataatgtacttttaaaaaatatcctaaagtcctatgacttaaagttcacattatcttccttcataaatgaaaaattttcatttaaaacatggaatcagtttatcaaagtacagtttacaggttttaagtctgttccatttctggttagacaaactcaaatacaatgatcaaactaaaagatttcttaaaagtatgatgactattaattgtctgctaatgaagtctgaaggtctgataagattatccatgaagcaaaagggaggaacaaaaaaactgttacatttctttcttctaatttttgagcctaaaaaccattttttataaacgtggtttcattgttctgacatcttaggtgtggcagttctctgcctcaagaaaatttgtaaaatttatattttagattttagcataatttctgaaacaaacaataacaactacttaccagtttttactgtagatactggactttgcctcttagggtgaatacttgtttgacttcaagcggggagagtatactttttaaccaatgacttgctgattttgcagttaagaaagaaaaacagaatccactgaaaataaaatttctatttgaaagtttcataagtgtaattgactaacgggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380526 - DNA, 998 bp, Homo sapiens
tttcctctttctctaagagtctctctctccctttccctctctctccccccaatctgtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccagggcctgaaacctcgtaaggcgcaatcggactcacattgcctgggagggagcgagggtattaatcagtcaaagggggccggccgagtggcacggtgcgtccggccaggcccaggaga

SEQ ID NO: 380527 - DNA, 277 bp, Homo sapiens
agagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagaagcttcctcccaaagaggtaccccaagagaccgat

SEQ ID NO: 380528 - DNA, 1789 bp, Homo sapiens
gagactctgtctcaaaaaaaaaaaaaaagaagtcatggtcatggtaaaaaacctatggctttggaaggctttctcggtaacgtcctaggagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccccccccaccttttttttcatttagatgtaacaaacctagtagtttatgttcatcaattgtctgtatatctctatattttatccatgtactcttttgatgtatagaagtagtttgaaactcattgtttccttgtggtaagtgaccgagatgctgccacaggacctgagacactgatgaatggtgctattttggactttcaacatgctccttggcgaggtagctctgatggagttattttttatttccatgttctaagaaggtgttggtactctgtttccctgaatgttgttctctagactggattgacttgttttccttgtgtcttcagtgtggctttcttcctcagtgttgtaggttgagcgaatgctaccagagtgtgagagaccattgtctcgttggctggcgctcacggacatgcagtcacggtagcgggagcaatcacaaaactgtaatttacttaccaaatctcttcctttccgtagcctcgcctgcctgacttagagaaagaaaagcaataattttacaggcattttgaggtgtctctttgggttctttctgtttgaaaggatatttgtcgaaaaaaagagcaaaaccgttttaaataaactccccctggaaaaaaacccaaaacactggcatctgagtaggaatatgaaaatgacaccttttccaaatattaaattggaaaacaaggtctacaaaatcatgatacttttttaaaaggcagagcattcttttttcggcaattttgataagcaaggtgtagatttacatttttgtccttgctcccaacgaaatggataaacaaaaataaattaccatctactcatggaatgttgttgtgttagccagtctgaaagcccaccttaatttttatataactgtctttagctcttcttttgacagggcaggccttgttctgaactgtttcgcttctgactgttaaacaccgatgacgcatgcactgcacttcttcgttttcttcttgctcccccattggcctgagtttcttgtgcattactcctctccctccttcgttagaataggtatatcagctgtgtaaatagagcaagaaaacagtattctgcatctgtggcatttatgtagagttgcagttgtgtactgctgaaaatgcaggcttttgtaacagtgtgatctttactgatgcactcatgacaagtacccaatgtattttagctattttagtagtatttgttcaataaatacgcaagctgtaaggtaa

SEQ ID NO: 380529 - DNA, 1746 bp, Homo sapiens
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380530 - DNA, 1569 bp, Homo sapiens
gggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380531 - DNA, 1846 bp, Homo sapiens
cagcctcccagaccagtgctgtgccagggcttgcccaagggccatggttgctatggcctgcaaccactgaaattttcttgggaccaaggccactttagtcagctggtgataaagtgggctgagactaaggttcttcctgcctaagcagtggattcacctctggcccacggtgggtcaaaatgctccccatatgagcactggtttggaatcaagggccatggggtctctgtcttttgctgtgttccaatgtggtggggccaggtctaagttccgacacaaagtcccacactcttatttccatttcccaagcaggcagtttttctctaagcactgcactatctgggtttggaagagaggcgtttaggcaagcatctccattttttttctgctgcttcatcgctgtagccatgggaatccgtttcattattatggtagcaatatggagtgctgtattcctaaactgtaagtgacaacagagaagtagattgcaacattgtcaatttaacaatgctaatgtattatttttgttagtattcataaacacagacacataaactagaaatattaaatgtatctttgtcacatttttgctattagtccagaaatttgtaaactatatttgcttatactataagttactaacaatacacacttttaatacttatggttattttaatagcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380532 - DNA, 1513 bp, Homo sapiens
tctacctcctaggttcaagcaattctcctgcctcagcttccaagtagctgggactgcaggcgtgagccaccacacccggctaatttttgtatttttagtagaggcagggtttcaccatgttggccaggctggtatcaaacttctaacctcaagtgagtcacctgccttggcctcccaaagtgctaggattacaggcatgagacaccacacccagcctggcttctctctatgaatatgtagagatatgcctttggttatgactgtaataatttaataatctgaaattttagagttggagtgaaaaaggcatttaatttgtctagacaaaatctgctataatggttcagatgtgtagaattaataatatattctccttttccagaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380533 - DNA, 1558 bp, Homo sapiens
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactgatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380534 - DNA, 1531 bp, Homo sapiens
  misc_feature (29)..(29): n is a, c, g, or t
aacttaggctaggtacgaggccgggtgtnaagaatcagatcttccctctctgagcagtgaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtagcaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcagtgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 380535 - DNA, 374 bp, Homo sapiens
ctgcagtaatgacctctggagggcacatgcaaaggccactgctccttcattctaacctcacagaaagcttgcagaagagcaatagggtcccctgcacagatggagggcctaagaagcattagactagctcggggcccaactctgggacccccaaatccaccagtttcccctgcagttccatctgcagccagccattctgctaggtgtaattccatggctgacacatctccatcctataacagtttcccattctctgtgctctggttgggattcttttaagcagcactttccttgtgaactgtataatgaaatgttctatgtctcaatggacatctgtgtgtgcatgtgcatatgtgtacatatgcatacaaaaa

SEQ ID NO: 380536 - DNA, 535 bp, Homo sapiens
cattttatatgctgttttgatattgccagtggttattatttatgtctttggaggaagaacaggaaattagaagtaaaatataccatgctttagataagttgctgaatattgtggatttctttaatggtttgacctttctcttcaggctctgtttgagcgcctgtacaaatgcccatctatgttcaatttcagcaaaggcaagttccctatacagtaagaataactcctggaatggttaatgatgcaagtttttcaaaactctcttctttgtaatatactcatgtcacatagtaaaggaagtagttgagcttatataaggctaagataacactttattatagtacagtattagatatttttagtaaaagcagatttacttttgccatagttgatttcctgctaaattttatacacatgcacacacactcaaattcacattagtaatttaaaaaatggaatgaattaactttgaccatgttttatattttacccttttgtaattatcagtgagtcttaaccatctctttttaaaaat

SEQ ID NO: 380537 - DNA, 874 bp, Homo sapiens
ctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctgggcatcctgattccacaaaattgtgagcttataattaaaatgttattttaaccacttaatctggggtaatttgttatggcaacaatagggtagccagaggaagtagcaattatatgtcagttaacaaggggtaaagggcattgaggatttgtaagaaaaaaatacaagaatggtaggttctctgtgagttattcaggatcctaagtggatacaaatcatttcccctgggtagtaacttcagcgaggatactgtttggaccgaaaagtatgcatgtaataaagatttatatctgcaaaatgatgaaacactggacacttccattttctattgtactttctcctataagaaagtcaataacatacagattgctgctgttgttactcctaataataatagtgaccaagttctgaatgccttttgtgggccagcactccactaaaagtacttcacatacactatctcactagtttttaccaagcgttagtttctgctatgtcaaatgaagatggtaatacataccttgcagagctcttgccaaagttttcttagctaagacatttcaaagtgagaatttgaacccaaaagtgtc

SEQ ID NO: 380538 - DNA, 443 bp, Homo sapiens
ctcggtaagcatcagctgtcattgccctccctgcctagaaaggtaattctggagggcaccagccctgcaaagtggagatctgcctgtctggccttgtccctttcttatctccctttgccatctctctcctgaaaggctcaccctaggctgtgtgggccaagatgaggtgatggcaggctcatctgagagaggagctttttcttcagagctcagcccacactgtgtgggctgtgtttttatacaacttgctgtaggcctgcatcaggtatgaaatttacatcatttgacttgcccatgtgggaatcttccccattcctcttggctccttagaatgggtacaggtgttcagtgcctcctcctcccaatgctcttcagcagatgaggaaccgaggtccaaagatgaaaacaaggctgatgactcacctgttagacacagttggcac

SEQ ID NO: 380539 - DNA, 371 bp, Homo sapiens
tgaaaacctgaatttcagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggaaagcacctccatgacccaaacatctcccactaggctgacctgtctgacaccgcactggggatcgaatttccacatgagtattggatggggacaaaccaaatccaaacatagcatctcccgtagttctaaagggaagagtcagcgttagatcc

SEQ ID NO: 380540 - DNA, 3099 bp, Homo sapiens
ataagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtggggcgtcacttccgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380541 - DNA, 3164 bp, Homo sapiens
cgccctgttcgcgcgtccgctgtccggcctccggtcacgtgacagcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccactcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380542 - DNA, 1287 bp, Homo sapiens
tagaggcatccccatggtcggtgaagaggaaaggaactgatgttccaagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380543 - DNA, 953 bp, Homo sapiens
ataagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtggggcgtcacttccgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccaggtcaggcctctctctagccccattctttccctctcctccctactcacatatagctcagctattgtcagtaatagatgccaactggggagaaaactcattggaagagagaatccataatcatatccagccctaaatgggatgagggaagctattctgtctgataagatttacaggctgggggcagtggctcacacctcggcctccccaagtgctgggattacaggcgtgagctagcatgcctggccagggattaaaatattcaaacatgttgtgtgtacccagatatgctgttaatttaggaaaaacagtacaatttctatgaagtggttgtgactattttctgtagtcaatacagttgggatatctgatctatttctctgtctactttggaaatgattgcataataaataaaattttactgttttttta

SEQ ID NO: 380544 - DNA, 127 bp, Homo sapiens
tttcctggaggacagagaccagagtgctgggggagagcctgattagcttttcagaacaaaactgactgcttcctggagaaagggaattggaactaaacctactctgaattgttggtctctctcccag

SEQ ID NO: 380545 - DNA, 3218 bp, Homo sapiens
cgccctgttcgcgcgtccgctgtccggcctccggtcacgtgacagcagcgcaggtgagcgccgcttccggggtcgggcgcctggatagctgccggctccggcttccacttggtcggttgcgcgggagactatggcgtcctcctcggtcccaccagccacggtatcggcggcgacagcaggccccggcccaggtttcggcttcgcctccaagaccaagaagaagcatttcgtgcagcagaaggtgaaggtgttccgggcggccgacccgctggtgggtgtgttcctgtggggcgtagcccactcgatcaatgagctcagccaggtgcctcccccggtgatgctgctgccagatgactttaaggccagctccaagatcaaggtcaacaatcaccttttccacagggaaaatctgcccagtcatttcaagttcaaggagtattgtccccaggtcttcaggaacctccgtgatcgatttggcattgatgaccaagattacttggtgtcccttacccgaaacccccccagcgaaagtgaaggcagtgatggtcgcttccttatctcctacgatcggactctggtcatcaaagaagtatccagtgaggacattgctgacatgcatagcaacctctccaactatcaccagtacattgtgaagtgccatggcaacacgcttctgccccagttcctggggatgtaccgagtcagtgtggacaacgaagacagctacatgcttgtgatgcgcaatatgtttagccaccgtcttcctgtgcacaggaagtatgacctcaagggttccctagtgtcccgggaagccagcgataaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380546 - DNA, 2656 bp, Homo sapiens
agcggagtactgatcggttgctctagcagatagcttacctctatatatgccccctagacgctacggtctcgtcgcgattactgatcttaggagctcctccccttccctttattcttcaggtcctctgcctatatgggggtttagtatgagacatgaaaaacccctggagctgacccgtggaaggggtggctggaataagctaaaaggatgatcttagatactaggacatataggcactaaaggcagtggtatgccctgcaacctcaatttttatacttcctttccccagaagggccccagaaattcaaaggtacaggtacaggggtgatacctagcagtgaagagtgagagagaggtgtctgatttgtcagtgggtctcagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380547 - DNA, 2423 bp, Homo sapiens
catacttccggactacatacttccgaaggaaaaggttaaagaattgcccacccttaaggatatggactttctcaacaagaaccagaaagtatatattggtgaagaggagaagaaaatatttctggagaagctgaagagagatgtggagtttctagtgcagctgaagatcatggactacagccttctgctaggcatccacgacatcattcggggctctgaaccagaggaggaagcgcccgtgcgggaggatgagtcagaggtggatggggactgcagcctgactggacctcctgctctggtgggctcctatggcacctccccagagggtatcggaggctacatccattcccatcggcccctgggcccaggagagtttgagtccttcattgatgtctatgccatccggagtgctgaaggagccccccagaaggaggtctacttcatgggcctcattgatatccttacacagtatgatgccaagaagaaagcagctcatgcagccaaaactgtcaagcatggggctggggcagagatctctactgtccatccggagcagtatgctaagcgattcctggattttattaccaacatctttgcctaagagactgcctggttctctctgatgttcaaggtggtggggttctgagacacttgggggaattgtggggatattctagccaccagttctcttcttcctttgctaaattcaggctgcaggctccttccatccagataactccatcctgtcgagtaggctctttctgaccctcagaaatacattgtcctttttcctctttgcccatttttcttccctctcttcctccccatgagaagtctgcttgtagtattagaatgttattgttgactctctcccaagtgccttgatctttgtaatatctcctgttgtttctatgatataggagctaggggaagggggttgtttgccttcttcaggacctgactggacagatggacctggctcaagcaactactctggatgcactttgctgtgtgggatgaactaaaagtgtctgaattttgctgataactttataaaactcactatggcatgcttccctcctggtgggccctaggatggatgacactcaagatactacagatgtgggtgcaggcatgcacacacacgatggaatatggccattcctacacaggtggggtagagagtgggtcagcagcctggcacctcacagaggtgggacctaagaggactcatgattatgcagagaattggattgggtctctgtcatagattgagtaatctcttcccttacctcaattccatctccacccatctctacatctgggcacagcaacccagagatggccaaaagcattcaagcctgggggaagatgtttgactattgctgctcttcaccagaacctcacacctctcctgggactggaacccttcagtgggtgtgtggccagttttggaggctggaatgatgggccagggtgtaggattcattctccatgtaaagtttcctttcatcctgcctagccatccccaaggtttatttccagaagaaaggaatatctctacttggatcaattctggtcatttcaagaggatggaggcctcaagtgtgggaacttcccctactccctggatgtgtgtacctagcacacttccttctcccacccctttttccagttggatttgtttttctgttctcttctgtcctgtcttatactgcaactgtgtctcctaggggacagatggccttctttgtcatcttcactctccacccccagagaggagtcagagccataactcaatcactcagcccctccaaagatagttgatgtgtgataatctcataatgttgagaaccctgatgagatacattgtcttcctctccctacaatgcctctggggccaaggcacccattcttcttgctatcctccatcccccttgaggcttccactttttttttttttagacataaagctgggcatcagcaactggcctgtggtgatgcaaagctgctttgctctgtatctggctggactgatctgtctcacaagaagccatgaggccatagggagaagctccctctccccttcatcttctgctccaaaggtggtagcaagaggagtacccagttaggggttggagcccccatataacatcttcctgtcagaagactgatggatctttttcattccaaccatctccctttcccccgatgaatgcaataaaactctgtgacaccagcaaccattgctctttagaaatgggttttctgatcatatggctgatgtgttatgggcagtatggatgtcttcatttgttgcttctgtttttcatcttttttgttttattaataaaaatttatgtatttgctcctgttactataataatacagggaataaattattcaatccaaatttctgtaca

SEQ ID NO: 380548 - DNA, 793 bp, Homo sapiens
  misc_feature (15)..(15): n is a, c, g, or t
  misc_feature (20)..(20): n is a, c, g, or t
tggaagctggcacancaatnctacagcagagagccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380549 - DNA, 4635 bp, Homo sapiens
  misc_feature (1)..(1): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagcaaccttgtgtactacagtgtcttcttcccttccccacaaagacaaggaagaagcagggtagaaggccacctaactgttccagccccttcatctaagatgtgggtcaacctttcaaaaaggggcagtatttggaccctaggccctttgccggccatggcaggatgttatactgtggcccaggcttctgctaaggccttggttatttttggcagtctggtttggtctctctttccctggcagttatacttgtctcctcctgcctgctgtcactctcacttccagcaagttgaagtcaagtatgaatgcattccagctccctgagaaatggtttatggtacagtcaggaacttgtctagattggtttgtaggctttgggaagtagggagaaggcagggtgggagacagccagggatctttcttaagttttcacatgttacatcctggagagatagaggtttagtcatcagaattcagattccatagacctagg

SEQ ID NO: 380550 - DNA, 3287 bp, Homo sapiens
  misc_feature (1)..(1): n is a, c, g, or t
nagagctgctccggccgcggccctgggagctggaggaaccgcgtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380551 - DNA, 1883 bp, Homo sapiens
  misc_feature (1)..(1): n is a, c, g, or t
  misc_feature (1681)..(1681): n is a, c, g, or t
  misc_feature (1715)..(1715): n is a, c, g, or t
  misc_feature (1717)..(1717): n is a, c, g, or t
  misc_feature (1879)..(1879): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctggtaaaagaccagtcttcctgcttctccacgaccccctcccccttttttctgaggctgattgttgctattactttactcttgtcctgtgctgtatgaatcatggtacttaacctggaagagcccactaatggctcaaaacccagcccaaaaggaagggggcagggatttttccaccgatagagaagggacagcaaaacttgggtggagaagggtttgagatgttggaagatgtggattgtttgacttactaactttgggaagacaagaggaagaacacttaatgtccctaacatccctgtagctcatgaatcgcagaggagaactgaagagggcttcctagaaatctgtcagtgtgtcctgaatccaaatcatgatggatattctctctttcttagcctttgcctgatcatgcagacatctccaactgtgggaactctttccagcttgtgtctggtaaggcatcgtgtgtgtttgtgtacgtgtgtgtacccattcctctctccacacatttctatcattggtttccagtgaccagggctagcgagcctacctctagaaccttcttgccagggtcaacttctgagattgacagttgtctttcatgttctagcatgaaagttatctggttggtttgctcttattctagctttgtggggacttgtataatctaattttttgaataggtaatacattcacatggttcaaaatttaaaaaataacaacaaaaaggttatgctgagaaaagtctctcttactctcccgttccctatctacccagcttctaccacctccctaaaagtattagtttcttatacagtatatgtgactagaatttctttatataaaaagaagcaaatgtatatatttatttcctttcttttttaagttctcggatacatgtgcagaacgtgcaggttcgttacataggtgtacatgtgccatggtggttagctgcatctattttatttccacgtttttaacacaaaaggttgcatactatatattattttgtacctttaaaaaaaaaaatgggaccgggcctagtgggtcacacctataatcccagcactttgggaggccaaggtgggcagatcacctgaggtcgggagttcaagaccagcctgaccaacatggagaaaccccatctctactaaaaatataaaattagccaggcgtcgtggcgcatgcctgtaatcccagctactcgggaggctgaggcaggagaatcacttgaacccaggaggtagaggttgcggtgagccaagattgcgccattgcactctagcctgggcaacaagagcaaaactctgtctcaaaaaaaaaaaaaaattgctgggcacagtggctcatgcctgtaatcctagcactttgggaggccgaggtgggcggatcatgaggtcaggagttngagaccagcctggccaacacagtgaaaccctgtntntactaaaaatacaaaaattagcctggcatggtggtacacacctgtaatcccagctactcgggagggcaaggcaggagaatcacttgaacccaggaggtggaggttgtggtgagcccagatcatgccactgcactccagcctgcacaacaaagcaagactccntctc

SEQ ID NO: 380552 - DNA, 4161 bp, Homo sapiens
aacttacggctaggtacgaggctggggtgtgtaatcggccgagggagagagagagagaactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380553 - DNA, 1861 bp, Homo sapiens
  misc_feature (8)..(9): n is a, c, g, or t
ctcgtgcnncttggggccacacagactgcctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380554 - DNA, 1934 bp, Homo sapiens
  misc_feature (1)..(1): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatctttccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380555 - DNA, 2605 bp, Homo sapiens
  misc_feature (1)..(1): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380556 - DNA, 4813 bp, Homo sapiens
gtttaaagcctctcctttatccacttttttgcttgtctccctaaaccatctgtgatgctagctgagactcgaatttacataagagccagaaaccatcaacccaacctcttcacacactaacgtctacattcaatctctttaaaaaagacttaaattttggctcatgtgggaggtggtggtagtggtggagacttaataaaaggtggttttgtcttcctgaagtggaaatatagcgccgtcaacatcttttccccatctgcctgtttcctccttccctttctgtttaaggaaagtctaaccaccgcacttctccccacctccccgcacctcccccccggcaaacgcaagcaactgaaccgcctatgatgtcataatcacaatcccattacctcatcctgctgggggggagggggcggagagagaagagagggagtgaacagccctgggctatcctgagctttacaaagtgttctgggtgagggcaaattacagaaccaagtggaaacgtccccgcaaccattataagtcctgggtttttaaggttcaggccgatccggcagctgcaagaggggctcctgggactccgagcaggccctaatccgcgcttggaccacacttcccagcagccttcacgccgcggacgggtcctttgctgggggaagggggattccttcgaagaggtggtcgtggagggcggggcagcagagcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380557 - DNA, 4165 bp, Homo sapiens
tgacttcttttacctttgagagggagtggcaggcagtagatgaaatgtttttgattccaggtagttggtcacaatggaggcaatagagcatagtggtttaaaaacctagccttcgcatcagacagacctggatttgaatcctcctttggtcttttgagtgctatgtgattttgggaaagttattgaatttctcttatctgtgaaatggggataatgataacgatactacctacctcataaggtttttggaaattttcacataaaatgctccatacattatgtggcaaatggtaagttcttaaaaaatgtaagctatcattaatattattcttattataaatgccttccagaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380558 - DNA, 4053 bp, Homo sapiens
gtttaaagcctctcctttatccacttttttgcttgtctccctaaaccatctgtgatgctagctgagactcgaatttacataagagccagaaaccatcaacccaacctcttcacacactaacgtctacattcaatctctttaaaaaagacttaaattttggctcatgtgggaggtggtggtagtggtggagacttaataaaaggtggttttgtcttcctgaagtggaaatatagcgccgtcaacatcttttccccatctgcctgtttcctccttccctttctgtttaaggaaagtctaaccaccgcacttctccccacctccccgcacctcccccccggcaaacgcaagcaactgaaccgcctatgatgtcataatcacaatcccattacctcatcctgctgggggggagggggcggagagagaagagagggagtgaacagccctgggctatcctgagctttacaaagtgttctgggtgagggcaaattacagaaccaagtggaaacgtccccgcaaccattataagtcctgggtttttaaggttcaggccgatccggcagctgcaagaggggctcctgggactccgagcaggccctaatccgcgcttggaccacacttcccagcagccttcacgccgcggacgggtcctttgctgggggaagggggattccttcgaagaggtggtcgtggagggcggggcagcagagcagactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagatccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatttaaaagcagcctatgattgcttctttttgtaaagcaagcaacctccctccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380559 - DNA, 4097 bp, Homo sapiens
  misc_feature (1)..(1): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtggggggttgagtcagcctcctcagagaaactgcgtgagagtgtgtgcgtgcatgggagtgtacttgtggaaaggtgtgtttgcgtagccttagggaaggaaggcaattgctccttaacagcagagtatcatgatacccccaggatcttgagttttttacaggatgttgggtttgctcaaggagtcaagaggagggcaccaagttttccttttttctaaatagctctggaaccaggcttgtaatccatagcatcaccgactctgcaaaggatttcattttggggtacagcagggtgttttaagtgctgtgacttcagctaatgatcttttcttcagccccaccccctccccactagctcgatctagtatattggggaatgcaggtggggggtgtcaccatattttttctgagctggcctttttttctcatcagattgtccaggctatattccacctgcctcttttgccctcttgagtagagttgcacacagcacatgggcaactgaagcagggttgaggggctctatctctctctctcctctgctgatgggacccttttcccctcaccctctgcccttctaagtcatagactaggtaggaaggccctatattggtccccagcatctactgaggcagacctgcaacagaagtggcattcagtccccagcagacatgggtgagctcaccccagcactgctgttgggaaggtgactgcaggaaaccaattcttacaagatccaggcccagcctttttgacctgcttgagagggaagaaggggtgtttagcatttaatagtttgcttgtcttccactcctgccaggaagtgtttatttgcctctaattgggcctgagagaccatagggaggttggggctcactgagggattggctgaggatgtataaagcaaaggctgtgagaagcagttgggagtttggttgtcattggattgaatttacttttttgtttctcacccgcaacttgagccaggacagctggtccaagtggccacagtgatgggtttaagtaccttggtagggctggcaccagtggaaacacatactgaagctgccaccacaatagcttgtgaggttttatccagctttggttagaccctgcatgaccaaatttgacctgcccttgtttatggcaagaagggcatttttctcttcaatttccagggtttcctaggacccagttcctcatgtaagggaggaagaccaaggtctttgtgttttcttcctcatggaattgaacctgacattttctggatctcctgcatgtcaggagcatcagtgaggcttcagcctccttcgtctccactccagagaggaggtggctatgtcttcttaagcctctggccctcagaggctcctccctatctcctggctagttaccactaggctaccaggtctctaggggcctgagagaggccctctagagaatccagggaaactgtgagcccaggagttgcccatctatggtttcattcctcccctggctcttctccctcttcaggccataatttccctggtgccaatttcttttcctcctggggcatcctcatcccagggctctctgctgtagattggctgtgccagcttccaacaggttactggcaatgccagtgagtttctgtaggccctaagctgaagaagtgaggcagtgattctgcctccatcctggtttccccaaagccccagggcaccatccttaggggagaaggtctacagttatcattattttaattccattactttcagtctggaaaactaagctagtcagaactgtcatcttgcttcccaatctaagaacctgtggccctggaacacttttcaagaattggttcattttgctttacacagtagatctgttccaacagttctgtgtaaaccaaatgctatttttcaatgcatttggactgctgaccatccactttagctgttttgactatttgaattttcacatattgggcttacccagagtggagcacacctccagggcatgtggctgacactgggtcaatgtctgcatctgtgctgtgtgtgtagtgtggttggccagtaggtgagtatccctgtgtgtgtgagtgaagccactccccaggctggtgctctcctcctgtgcccagtgactgcccagtggcagctcagctgcccttcactcccacctgctgccaaagtccctgtgctaatgggattacaaatacaaaaagtggaaaaaaattttcgtaaactttgttttatattaaaagaaaaatccataagtctgtgtgtgttaaacatgaggttctgcctctgtggctgtgtttgaaaaaataaagttttattagaataatccattttcccaagca

SEQ ID NO: 380560 - DNA, 1785 bp, Homo sapiens
  misc_feature (1)..(1): n is a, c, g, or t
nagagctgctccggccgcggccctgggagctggaggaaccgcgactcagcaggcatgactggagagggaagtcccaatggtgctagaatggtgctgcagtggcagaagacggctcacaagtgaggtctggaagaacaacagggaagacatccatcatttgctccaaagtgtgcaagtcaaatcctggggagaatcatgataaccctgatcactgagcagctacagaagcagactctggatgagctgaaatgcacacgcttcagcatcagtctgcctttgcctgatcatgcagacatctccaactgtgggaactctttccagcttgtgtctgaaggtgcttcctggaggggcctgccccactgttcctgtgctgagttccaggacagcctcaacttcagctaccatccctcaggcctgagcctgcacctcagaccacccagtcggggaaactcccccaaggagcagcccttctcccaagtcctaagacctgagcccccagatccagagaagcttcctgtgccccctgcccctccatccaagaggcactgccgctcactctcagtgcccgtggacctgtctcgctggcagccggtgtggcggcccgccccctccaagctgtggactcccataaagcaccggggcagtggtggagggggtgggccgcaggtgcctcaccagagccccccaaagcgggtctccagcctcaggttcctccaagctcccagtgcctcttctcaatgtgccccagctcacagaccctacagccctcctttcttcagcctggccctggcccaagattcctctcgaccctgcgccgcctcccctcaaagtggctcctgggagagtgatgctgagtccttgtcaccttgcccacctcagcgccgcttctccctgtcacccagtctgggcccgcaggcaagccgcttcttgccctctgcccggagctctcccgcatcctccccagagctgccctggcgacctcgaggtctccgcaaccttccccgaagccgctcacagccttgtgatctggatgcccgcaaaactggggtcaagcggcgccacgaggaagacccccggcgtctgcggccttcgttggactttgacaagatgaatcagaaaccatactcaggaggtctttgtctccaagaaacagcccgggaaggcagcagcatctctccaccatggttcatggcctgtagccccccacccctctctgcttcctgcagccccactgggggttcctcccaggtgctgagtgaaagcgaagaggaggaggagggggctgtgcggtggggtcggcaggcgctgagcaagcggacactgtgccagcgggactttggggacctggacttgaatttgattgaggaaaactaaaactgagaggctacttcctggggccacacagactgactctctcatggctactaacaagtgtcgagtccccaaggctgggggccgagcctgggaatgggggtgagtggagggctccgactcagggcagctggaaatcttctcgctccagcaagctcgaccatgccaagagactggccgggacaagataaacggagctggtggcgggagggacagccccagagcagacccttcctatggcggccctgagtgtgagtatccctgccaccaagagagcaatgggcagggaaggaaggggtctgccgaccccagctcggggaatttcactagcccctttgcttcaaagggcacttgtgtcttagaatttggccagggtgggggtatcatgatactctgctgttaaggagcaattgc

SEQ ID NO: 380561 - DNA, 489 bp, Homo sapiens
tactggttcaggaactgaggctgggaggcgtaagtcactttttatcaagctgcccaggtgatttttctggacagaagtctgaaccagccccctgccttctgcatttccacctgcctgctggattattccacccccagtgacccgcagcgcccttgaaagatgctgcagcccacgccggtctccagaaagccccggcggaatgtacgttgctgcctggaagaggccggctcgccccagagagaggggctacctccttcaggcctcgtccttggtgccctctcttcttctccaatggtttctatttttaaatatttcaactgttactgttaagtaatagtggttcctacttcggcccagctgttaggtgaaacacataaccaaacgtttggaggttgctaagaaggaaattctgaaatgcgttcttatgtaaacttgagcctgagaggcagaggtttcagtgagctatgatcgcaccactgcaacccagcc

SEQ ID NO: 380562 - DNA, 568 bp, Homo sapiens
aaagaaaactacacaccaatatccctgataaatagtggtgcaaaaatcttccacaaaatactagcaaacagaattcaatagcacatgaaacagattatacagcacgaccaaataagatttattctggactgcaaggatggttcagctggtgaaactcagtcagtgtaatacaccacatttacaaaatgaagagcaaaagccacacaatcatttcaatggatgtaggaaacacatttgacaagattcaacaccctttcataataaaacactcaacaaaccagggatagaagtaaactacttcaactattaaaggcgatttatgcaaagtctacagctaacatactcaatggtgaaaaactgaaagcttttcctctaaaatcaggaagaaggccaagatgcccactctggccacttctattcaacatagtattagaatttctagccacagccattagacaagaaaaagaaataaaagtatccagattggaaagaaagaagtgaaactacctctgttggcagttaacatgatcttatatgtagaaaaccataaagatttcacaaaaaaaaa

SEQ ID NO: 380563 - DNA, 1074 bp, Homo sapiens
catgtcctgtgaaaccctgtcaagcaataaataattggtactgttaaatttcataatggaaaaaattggaactcaaagtattaggagtttggcattgattttaaaggacaaagaaagaggctatgaattctcaaagatactaaacctgtaatgggatggacttcttgctctgttgaaaaggcctggtctctggaagatgaacttaaaaccagcttctcaaggtggttcatttaccacacatacttcagtgctcttttctgatttcatgtcccttatcaaggtttatgatttggggaccctcaggatttaagtgatcatggagaagggaccataggtattgctggctcttaacagggcagttaacatagctgaaggatgtgggctttcttatgttctccatgcctaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 380564 - DNA, 1025 bp, Homo sapiens
tgggcaaaatggtcacataatagcaccatcacaagacttgccaggaatctagagcaagaggataacgtctaaagcatctagctcaggtcctcacatctggaaggtattaaatacaggctagctccttccatagatgcccatccaaagatgcatacatgaggtggcaggggattaaactatatgacccctgagatcctttccagttcttagctttgaggggggtcaatggcagtaattcagatatattgtttatcatagttaattgagtatcaacatgtcaaattggcatttattgtgttaccttgggcaaatgatataacttaagtcttaattttcttcattcttgaaatgggatagtaagagtacctacctcataatgttatgaaggtttaatgagatagcctcatgccaggcacagagtacacagtaagtgctcaatacttaactattattgttagatgttggtttgcttattcttctggctctgatttttttcccctttactctttttgtttttgtttgcatttcagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 380565 - DNA, 1139 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 380566 - DNA, 1854 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgaaaaaaaaaaaaaaaaaaaaaaaaaaaaaaaaaaaaaaaaaaaaaaaaaaaaaaaaaaaaaacaaaaaaaaaaagaaaaaaaaaaaacaaaaaaaaaaaaatagcagaagaacaccaacacacaagacacaacaactacaccagggaaacaaaaataagaaagagacaatgataaatacaacgcggggtagcacacgatcgaagacatatctcatcaacataataccgctcgactaaagaaaacaacacacgcttcatatttcgatcgtcggaccgctacaatgagctgtgatctacacacaaacaaaaaatacacaaatacatatgcaaacacaatataacacaccaagcaatcaactaaaataatatctaattattatctttacactatttatatcatttaaaaataatatacaataaataatctataagaaaaataagttatatcctcagctaacaacaagacaaatatgtaatataagacaacaacactcctaactctgcgctatgagagaaacgacgatatagacccagtgcgacttagcatacgatttattaggactgagacgaaggtagacatgtaggagtcgaatattcacgctcgtagacgacgaggtgcgcaggaagcgaccgcaacatgtagtggtgctccggcgggggtgtgggtctgataacgctccattactagagtacagcgatcgggaggggggggaggc

SEQ ID NO: 380567 - DNA, 1729 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgacatgtgtggttgtccttgattaagttcacagatttcaccaaataggcacactaatttaaaaaatcactgagttgtagtcataacttgtacccagttaggagcaggggtagataactttatttatatggggatagacagttgctctgatgttggtttgagaacgtaaactccaagagcgggttctgggttctcttttaattcaaggccaagcttgtaaattaggctgccttaaagaaaaaaaaaaaaaaaaaaaaaaaaaaaaaaaaaaaaaaagggggggggggtaaaaaatttccccgggggggcccaattatgggaccacaggttttttttgacaagggggcgcccatataagagggggcggaatattaaagacaagggagggcccggggagtaaaaacaacggttcggtagtgggaaacatcgggacttggagatcttttgggagagagatccctacttgttgtggtggggacatattggggcaactctcaaagatatttaaggctcagggaaaaataaaacttagctcttactgggtaacaccggtatatttgcgggaagagtggctacgagatgttagaattacg

SEQ ID NO: 380568 - DNA, 820 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgaggtgggtccttgccttctgttgaggagcttgtactcaaatcactccacttgaacctgacctagcagaggtagcaagaggccatgccatttggtaacctcacagtaccataagagatctatcttaggtggacaaagccatggaatttgctatgcctaagtccttcagggtcatagctg

SEQ ID NO: 380569 - DNA, 1549 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagccttggatcctgaagaagatcagattttgtggtggttttagaattaaatattttttaaaaccccgtaacttaagagtcttagagattttattggaaagtatagactatttctgtctagtgtttataagtgatgaaatgctaaactgggaggtttatctatcttcaaaatattaacacactggaaagacctggggccttctgcatattgcatgggagttttagggccctggtggaatgaaataaatcgaggagcctggcacctttttaagatgtgaatgtcacacaatcacagcatactcccatgtgcttaagagtgatactctcagtatctgcctatcttgtgtccctttgtaattttttaaccccagaactctattccctccttcaggatgtcatacattatctttttttctctccatgctgctctgaaatcctgcttagaaaactattaggaaatggctgcagtcctgagctgtgagcggtaaacacagcctttgagagcaggagcacatttccctttcatgacatcaggtagggttgtatgactcccgactagttttagcatctgagtcttaccttcccccccactgtattgaagaatgttggtgatcttttaagaggtactctgtatagtttgtcattcatacctacaagaaaacaaactttagattttttgttgttgtgttgttaccttcagctactctttggttatttc

SEQ ID NO: 380570 - DNA, 482 bp, Homo sapiens
atgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccggtgaggcccccgcgcccctgccctctcctcctcggtgcctgaggcccccgccttccctgctgtcccctcccccagggctcccctccccccggcctcccctccccccgcctccgcgcagacccctcacggcgccccctcacgggtggaggatgaggcagcctctcctcgcaggcccgggccgtccttcgcgccgtcgtcacttcctttatttttattattccaatattttacttagaaacccaaaagctgagcctttggagggcccaagcccgcctgcaccggcctcggggggtc

SEQ ID NO: 380571 - DNA, 899 bp, Homo sapiens
cccgctcaagcagtttcttccataaatagcatcctcgtgccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 380572 - DNA, 1535 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattgacatgtgtggttgtccttgattaagttcacagatttcaccaaataggcacactaatttaaaaaatcactgagttgtagtcataacttgtacccagttaggagcaggggtagataactttatttatatggggatagacagttgctctgatgttggtttgagaacgtaaactccaagagcgggttctgggttctcttttaattcaaggccaagcttgtaaattaggctgccttaaagaaaaaagcattgcagataaaggaagggaatgggaaaaataaacacacggtggcttttgcctgtgatcctagccctttgggaggccaaggcatgccagaggatcccttgaggccaggagttcacgaccagataggcaacatagcaaaacccccacctctactt

SEQ ID NO: 380573 - DNA, 1092 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 380574 - DNA, 1508 bp, Homo sapiens
gcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggtatgttcctttcaaacagaatgagatgatacatgtaaaatacttaacacagagtctgtcttccaagaaatgatagctgttattcttcagtgcatgggacacgggggctttcttttcaatagcctgtgtgaagccttgccctggattgccaatgaggaaagtatcctgcaaatgaaattgcgctgggagtgcagccttggaagaacataaccatatttcttgtaaaggagttttctagtggtgagaaggaaagatgatgggaaaacttgagctacaattctaaagatgcttcttttggaatatacttggcatcagacatggtagaaaggcattcaaggagccagatttgaacaacttacccagccttggatcctgaagaagatcagattttgtggtggttttagaattaaatattttttaaaaccccgtaacttaagagtcttagagattttattggaaagtatagactatttctgtctagtgtttataagtgatgaaatgctaaactgggaggtttatctatcttcaaaatattaacacactggaaagacctggggccttctgcatattgcatgggagttttagggccctggtggaatgaaataaatcgaggagcctggcacctttttaagatgtgaatgtcacacaatcacagcatactcccatgtgcttaagagtgatactctcagtatctgcctatcttgtgtccctttgtaattttttaaccccagaactctattccctccttcaggatgtcatacattatctttttttctctccatgctgctctgaaatcctgcttagaaaactattaggaaatggctgcagtcctgagctgtgagcggtaaacacagcctttgagagcaggagcacatttccctttcatgacatcaggtagggttgtatgactcccgactagttttagcatctgagtcttaccttcccccccactgtattgaagaatgttggtgatcttttaagaggtactctgtatagtttgtcattcatacattttaccatgtgcagttttagctgct

SEQ ID NO: 380575 - DNA, 1341 bp, Homo sapiens
acccaacggtaaccatcctgatactaattcttcagattggtttatctggttttgttttacatatattttgtactttatatttttaaaaacactctgtttcctcttgtgtgtctggcttctttcattctgcattacatttttagaccatccatgtcattgcatctagctgtgaatgatccactctcatggctggtttgtgcgtgtgagtgtcagagtccgagttgtgcgggtaagggggcagtgaagaatacccacaatataattatccattctgctgttgatagacatttgggtagctgtttccaatttagagttattacaaacagtactgctctaaacattctgatcgtattctttggtgaacatctgtacacatttttgttaggtatatttatacccacaagaaaaaatgcttgtcattgagtatgcatgcattcagtacagctttaccgccaaccagttttcaaagtggtagttgtactagttgacaaccataccggtagtgtatgagaagtccgatcaccttctgtctctggtgggtagtcagtgatctccattttcatgacagttaatgaagtcgagcacatttccgaatatatgtttacatttgtcgtatctacatatcctcctttgtgaagggcctgttaagtcttttgcctgttttcctgttgggttacctgcctccttcttaatgttttatagttctttattttggagatgagtcacttattgactatgtatattggaagtatcttctactgtatggcttgcctttgatttttttagtcaactccttcgatggattgaagtttttaatcttcatataatctgactgatccttgttttcctttatgtttagctgcattaggtttttggttgctgttttagaaatcattacctgttcccagctcatgaaaatattctcctcttatttcttttaaaaatattatttgttcaacaattttttgatgtcatatttcacagatgtctcttagataccagctatatttcaatatccatttattgagaataatgacaagaagcttgggtaaagcttttaaacagatttgtagtatattcacagcagtgtctagtcatttgaaaagtagttagaagacattgggagatactttctcaatgtagaaaccatgctgtgtactccccacacagatccgcagacaactcaaagtggtggaggctcaaggcttgagagaacctgagtcagcggagaggccatcttagccttgttaatgtcaaaaggtgtacatgtccatttattccatgtttacaaaatacttctgtgtcaggtattgtgctgataagatactggaaacataaaga

SEQ ID NO: 380576 - DNA, 432 bp, Homo sapiens
ggaaccagtggctagccaggccacggcgggctcaagagatctgacatcttaaagttatctgattaatgttcataaaacggagcttccactttgggaagcagttgagtacattcctttgctgtcctgccatagaatacccactgccaaggcaaaggtatgcatccagtacaccacactctccgctgctagcgatcttgagctaaggcttgggctgcaggcgacttctctatagatacacaaagatttaacgttccttaaacaaaaataactgaaaggacttctagagaatatccacttgtcttataaaaggactctcagcccagagagcttctgtgccttgtcgatagtggcagagctgggatcccaatgcttctgccctgctggtttgagtcacattctccatagagcagtttgcccttcccagttctgtgt

SEQ ID NO: 380577 - DNA, 741 bp, Homo sapiens
tgtttgaaaaccaatgctcaaagataccacgttttgttttttgttttttttaaactgccgggaagagaagggtcttagaattagaacatgttctgaaatcatgctttatgcattccagagatgcatggaaatcataagtagaggtggttgatttgatgcttccacggaacttttttgaatatacttctggcaaagaagtaagtctatacaaagaagtaagcaaagataagtctggcaaagaagtaagtctatacaaagaagtaagcaaagataagtctggcaaagaagccagaatcccgaaactgtgctggatcctgtattctgtgttccttctctcaccgtttatgaggatgctgatctcttggagatgacaagctaataatttaaatttatagggcgtggaattcctttgcagaagaaaatgctttccataattactaacctcaaaaaagatgttgtagagtgtatttctttcccagcatagaaagctttgttttgtatcccatgtaatttaatgggagtgtgtgtcatgaaacgggctttgaagtgggaagcaaggtgcttccattttctgttttgtaaaccaaaaataaaatttgaaggccccccacaaccatctgaatggacgaccatctgtatggactctttccccagtcagggcactctaaaatttaacctgaaagactggttcaggccatgaaaaaggggatgggggggttggacatgcgtaattaacatcaa

SEQ ID NO: 380578 - DNA, 420 bp, Homo sapiens
agctttttaaaacatgtcttgtttctttctcatgtggtaaatttatcatgacaactctaggctgtagaaggcgtaatataaaatacaaactagttttggttcttataaaaggctgatttcagttaagactggtcatttttttaaaaagctgaattacactgtagtataaaagcaaacagtcaactaagcaaccaaacaaaacagctctcttctttaataatattcatcattgccaaatgtttatttttgaaattttgttctgtgccaacttgtttcaccatgttaaactgcatacatacccatgaactatttatttacaatacatttgatctcgttaagaccccagttctatttccaaggcatgcagcccaaaaccaaaaagttaaaagatgataacactctgtggttgaattacctatg

SEQ ID NO: 380579 - DNA, 884 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattgggtgggtattgagctcttcggcccttcctcggtactgatagtttttaatttaggttttaaaggtctaaagatgcgcccgttctggccatctcaggtgaaatgttgaaacgccccagaacctataatttttggtttcttagtaaacatacgatccagatcttgtgtaattccatgcccctcctcctcgaaatttggaagtagtacatggtaatagggatgtgtaaagcagcttttagcagcattgcttaaatttatttgaagaaattggcctgtcttgctcttaaactcttgggctgtaggttttccttacatatttctctgttttatgtcgtggttttgacttgcctgggaaggtgcaggcgcttatttatcctaaatgccctgaagtgtttaggctacaggctgtagatcttatactgattttttttcttcagttttcttgcttattaagaataaatattgactcca

SEQ ID NO: 380580 - DNA, 629 bp, Homo sapiens
atccgtcgctcacgaggtcgcgcctcgcacccgccttcctccttttcttttaccctccccttcagaaaaaacggcggttgggctgcgacggccgccaaaggcggactagaagcggaggggtgaaaatcccggcagagaaggaagaagggactgcaggcgggaggaggaggaggataaggaggaagggagcccgcccagccggagccatctccgtcgagaacaaaatggcggcgctggcggagggccaactataaggcggggccgcggccattccccctccacccccacccttgcgccggccgggccggtcagggggaacccgctcgcttcgcccggccgcgggcggggaggggaggggagcggcccggcccactatgcaaagcgccgggcgccgccgccgccaccccgtggcaaaggtcgaggggttaatgctctggaagacggatgaaaaggcactgcccgagaagcggggtgaagacagcgggaagctcatgctcacaggccgctctgtaaccgaaagaagccacatggaagggagaatccacatattggaaaatggtgcccgaacctctgtttcctccctccatggagtgaataactccctccagggaaagcggtttcaggcatga

SEQ ID NO: 380581 - DNA, 3788 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380582 - DNA, 3743 bp, Homo sapiens
accggaacgccgcagccggcgctcggtccatccggcccgtgggctgtggggccccgggcggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380583 - DNA, 3735 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacagaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380584 - DNA, 3734 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380585 - DNA, 3325 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcataagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380586 - DNA, 3955 bp, Homo sapiens
  misc_feature (3794)..(3794): n is a, c, g, or t
  misc_feature (3797)..(3797): n is a, c, g, or t
  misc_feature (3799)..(3799): n is a, c, g, or t
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcaaaaaanaananaacagcaacaaaacaacgttgtgtgggggggccgggccccgggaaaaagttttttgcagacccactggtgggggggcggggccccagtggttagcgcaccggggccaaggtgtcccgggggaaatcgggccaaacaggggtgggtttccccataaa

SEQ ID NO: 380587 - DNA, 1684 bp, Homo sapiens
gcctactactactaaattcgcggccgcgtcgacaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380588 - DNA, 4214 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctcacttttcctcaatatccttctatttttatatatctttctttctttctattcctttctaatctttattatattattttaatctctttcatttttttctactctcttctcttctatctttctaattcacgatttctactctattatattttttctattactccatatttatgtctattatcttattctaattatacttttttctcttttacttttcttattatctctccttctaactttatctctctttctttatttgatcttttcttttattttctatattattcttttttttttttactcttctcttttatttgtcttatttctctcaattattcatatttattctctctcttactttctacatattcttactcttattttttataccttcttcttatttaccttcctatcctttcttgtttctcct

SEQ ID NO: 380589 - DNA, 3730 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcagggggatgttttactctaggaagttggatagctaaatagggttcctttggagtaataatgtcggagcttggtttcataaggggggataatgcttcagatttttactggtaaattgtaagttgctgcattatttcaaattgggcggtgtactgtgaccacggtgtaattatccaaaaaaggcggatctgggagcctttgtatagaaaaggagaaaat

SEQ ID NO: 380590 - DNA, 3004 bp, Homo sapiens
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctgtaggtcggaagtgggggttgtattggaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcatgccgctgcttgtatggctttgtctgggctctgaccctgctgcgcattcgttccaacatcacagaggaacggcctctcctcctccctgcctggggagcccagtggccagggttttgagtggtggagccagtcgc

SEQ ID NO: 380591 - DNA, 1181 bp, Homo sapiens
  misc_feature (974)..(974): n is a, c, g, or t
  misc_feature (1035)..(1035): n is a, c, g, or t
  misc_feature (1062)..(1062): n is a, c, g, or t
  misc_feature (1075)..(1075): n is a, c, g, or t
  misc_feature (1087)..(1087): n is a, c, g, or t
  misc_feature (1096)..(1096): n is a, c, g, or t
  misc_feature (1107)..(1107): n is a, c, g, or t
  misc_feature (1140)..(1140): n is a, c, g, or t
  misc_feature (1154)..(1154): n is a, c, g, or t
accggaacgccgcagccggcgctcggtccatccggcccgtgggctgtggggccccgggcggcggcggctacgtagctgccgccggccttggccgcggccgggcgggcggatatgtggcttaaatggcgcaggcgtcggggcctagaggctgaagggctggtcgtcctaaaaactcgtggacgtcgcgcacggttacccggacgcaggcccgcccctctggggaaccgcgagctcctcgcagctgggtggggaccgtcctcgcagtggcggcctccaccctgccttctcgcttagccaaggcttctggaaggctcgcaaagtgtctgttgttggaagaagccgggccctgactggcgcgacggattctcccagccgctcagcagagcgtctaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaaaggtccttggtccactggttcccgtgggtcntgcttgcccccattctggatccccacttacaaggtttttccttggaaatccctggggtggnaaaacccatttaccaattcttggaagnaaaggtcattggncttccaaggccnaaaaatttnggggttaaagnaatggccacccccggaaaaaaaaccttggcccnaattaacccttggnctttggccccttggccaatttgggggt

SEQ ID NO: 380592 - DNA, 3787 bp, Homo sapiens
atccgtcgctcacgaggtcgcgcctcgcacccgccttcctccttttcttttaccctccccttcagaaaaaacggcggttgggctgcgacggccgccaaaggcggactagaagcggaggggtgaaaatcccggcagagaaggaagaagggactgcaggcgggaggaggaggaggataaggaggaagggagcccgcccagccggagccatctccgtcgagaacaaaatggcggcgctggcggagggccaactataaggcggggccgcggccattccccctccacccccacccttgcgccggccgggccggtcagggggaacccgctcgcttcgcccggccgcgggcggggaggggaggggagcggcccggcccactatgcaaagcgccgggcgccgccgccgccaccccgtggcaaagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380593 - DNA, 3526 bp, Homo sapiens
gccaaagcggcctcgaagcgggtcccgtgtctgcggcgggcggcccccggcgcggagggcagggcgcggggagcccgggctcccggtgtcggcggatggcgggagcccgggggccgcgggctcgcggggcagcgggcgagagacgagacgccgagaatatgctttttgtctaatgatgttagataaaaagcaaatttggagcagttttcttattcgagttcaaaatggttcataaagcagcgaagacaactcaaaacatcagtaacacatttggcccaggaactgctaacaaacatacagtgcagtggtggcttaagaagttttgcaaggaagagagccttgaagatgaggaacgtgatatgggccatgggaagttgacaacgaccaattgagagcaatcattgaactacatgaaaaattacagaagaactcagcgttgactattctacggtcattagggtcgttcagcattcgaagcaaattggaaaggtgaaaaagcttgataagtgggtgcctcatgagctgagcggaaatcaaaactatcgttttgaagtgtagtcttcttttatgctacgcaacaacaaaccatttctcaatcggattgtgacatgtaatgaaaagtgaattttatacaacaaccagctcagtggttggaccaagaggcagctccaaagcagttcccaaagccaaacttgcaccaaaaaaaaggtcatggtcactgttcggtggtctgctgcccatctgatccactacagttttctgaatcctggtgaaaccattacatctgagaagtatgctcagcaaattggtaagatgcaccgaaaactgcaatacctgctgcctgcattggtcaacagaaagggcccaattcttctccacgacaacacctgactgcgtgtcgcacaaccagtgcttcaaaagttgaaggaattgggctacaaagttttgcctcatccaccatattcacctgacctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaatagaatatgttttagcgtagttacaatgatttaaaattcgcagtctggaaatttaatttttgcatcaacctaatatttctatggtaaatccttgcaaacatggaaacaatgcatttggcccagtgctttgtggttgtgtactctttttctttgtttttttaatagatggcattggccgggcatggtggctcatgcctgtaatcccagcattttgggagggtgaggtgggtggatcacctgaggtcaggagttcaagaccagcctgactaacatggtaaaaccccatctctactaaaaatacaaaaaaattagctaggcggggtggcgggcatctaattccagctacttcatgaggctgcgacaggagaatcatttgaactcgggaggcagaggttgcagtgagccgagatcacaccattgcactccagcctgggcgatgagcgaaactgtctcaaaaaaaaaaaaagttggggtctcgctgtgttgaccaggctggtctcgaactcctggcctcaagtgatcctcccatcttggcctcccaaagtgttgggattacaggcgtgagccaccacaccctgcctggttgtgtactcttttaaatactaagtttttaatgttaaatgctgcttttagatacactgtaaaaatacacctatcaatgagtttttttattaaaaacattgcaattgtactagactttaaatactaagcaataattcaggcttcaatgttggtttatagttttctcatttctttcatttaatacctctgtaaaatgaagcagttacttccattttcctgaggtgagataagtgccctgcacaatgttataggcccagtaagtgagactggagctctgatctaatccctttgacattaaagtttgtgcagtaaaccagctatgtcagtttgccacatttgtaatagtgttcaataaattttcacttaaaggtttaatattaaagtagtagcaagaattcataaccttaattggctttaacagcttttctttccctgaaaacagatgcatatgtacacatgcacacagattgcttacaatatcagcacgtaaaaggcctttgcacattgaagtcggcactgctttggtgccttttttgttttttggctcggtgttttgactgcaagtctttttggatagaattttatagttagaaagtagctaacacttgggttttataggcacaaaaaacaagtcttatactagctgtactttattttttgagttcttattaatgaggaacatccacttttgcattgacagtgatttcaagattgctttatcagcctttaaaggattcttgactagtcgtgcacatcagaactgccaggtccccagtggttctgaagcagtaagctttgggtgggctctggcatcagcactttcactaagcttcacagataattctgatgcatactccaggcctgaaccactgatcaatttgaaacatgcataacaaagcaaaaaaagttttgtttcaccttttgaaatacagttaactcttttaccatgccagagatcattcagagagacaggtcgttgctccggagtgatacagatctggcagtacccagcccttgtgtgtgtgcgttagctcagcacctgcccacactgcgagcccccgtaggatgtgccttgtccttccctgtttcagcacttaacacactacctggtacagagtatgtagtgggcatctgttgaatgaatgcttttcccagtagcagtgtattcatacaatattaatataattgtcccctggcttacagataaaaatgaaagcatcaagtgcccagtgagtgagacccaggtgttcttcctccacccctagtggtcccctgggcaggtctttttttttttgtaacactcaccagtctgttctgtagtcaatcattgattgacttgtctgtgaacttgcaggaactgtttcatagtttcattagcacagagtaaacatgtttgccatgcaaggttattttgcatctgcatttaagtgataatgttgaatcaatgaaaagtgttgattaagcagtagttgtagatatgctaagtttttcaaattactaatatcaagtggagattgtttttacttttaagggtattgcttttgtgatagcataaataatggttttccttttttgtaatgtaaattaattgctggcaacttttgtattcccatagactggggaagcttaattgcctttacaagtacttatgtacaactttgtatcaaattttctgtaatagtttatgctttagtactatatatgtactaataattttatctgacttctgtttatatcatttgtacaattacatggttgtaaaataaacttttaaacctca

SEQ ID NO: 380594 - DNA, 724 bp, Homo sapiens
tgacatggaaggaccaacacaggaatttggctcctttagaatgaagagcccccgtgatctgtgcagtctgcttgggtactagatctaagctatggggcaggagaaaaaggagagaaaagaaagaggaggaggggagaggtagagagaaggatgggaaagatgtcgcctagcaccatcactgtcaagtcggtcctcgtagctgggatgcttccattaggaatgctctgtctggaagagactggtcaggctgggacagggcagggtctgactccgtctacccaggatgaccatgaaccttccaaatgccctacttcccacttgggtagccctgcctgctttacctctgtcagggctgaagggactttcttctgcttcttgaaggtcgaggggttaatgctctggaagacggatgaaaaggcactgcccgagaagcggggtgaagacagcgggaagctcatgctcacaggccgctctgtaaccgaaagaagccacatggaagggaggtgagaggcgtgcctgcggcttgtctttggaacactgattcctgtaaaatccctctaggaatgtgagccatgggggttaagtgggacctgaaagtcaagcactcttcctccctccctcctgcaggaacagacaaaggctatgggggctggggaggggacgcttttccagggcgctggacagcccttcacctccaggcctccaggtagcagggactgggctg

SEQ ID NO: 380595 - DNA, 1244 bp, Homo sapiens
tcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattg

SEQ ID NO: 380596 - DNA, 3038 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattg

SEQ ID NO: 380597 - DNA, 1080 bp, Homo sapiens
gctggtacggccggagagtttgggatctggcccaggcattggaagtcgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcaga

SEQ ID NO: 380598 - DNA, 946 bp, Homo sapiens
caagcaattctcttgcctcagcctcctgagtagctgggattacaggtgcccaccaccatgcccagctaatttttgtatttttagatggggtttcacctgttggccaggctgatctcgaactcctgacctcaggtgatccacctgcctcgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgtctttgggagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactga

SEQ ID NO: 380599 - DNA, 6561 bp, Homo sapiens
  misc_feature (6285)..(6285): n is a, c, g, or t
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380600 - DNA, 6579 bp, Homo sapiens
  misc_feature (6303)..(6303): n is a, c, g, or t
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtcctttgttcttttgcagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380601 - DNA, 5538 bp, Homo sapiens
  misc_feature (5262)..(5262): n is a, c, g, or t
ggtgattagaggatcctttcttgcccagactcgaatggatgtcacacttttggaatgcagggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380602 - DNA, 3528 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattgcccccaaattttgcttttttttgccaaattccccttttgggggggctttaaaaatctaaggggccggttttaataaacttgcgtcgggaaaaaacctggggttccaccaataaaccccttttgaaaaaatctcctttttccgagggggcattaatctggaaaagctcctccatatgtccctttcaaaaagtttgatcccctatatggctaacgaaatatgttccggttaatttttttaaaaatcggtgaaaattttttcaaaaacgcctttttttttatacacaatagtgcccaattctggactctttttttattcatatccccccggttgggg

SEQ ID NO: 380603 - DNA, 5405 bp, Homo sapiens
  misc_feature (5129)..(5129): n is a, c, g, or t
caagcaattctcttgcctcagcctcctgagtagctgggattacaggtgcccaccaccatgcccagctaatttttgtatttttagatggggtttcacctgttggccaggctgatctcgaactcctgacctcaggtgatccacctgcctcgacctcccaaagtgctgggattacaggcatgagccacagcatccagcctgcccatcctttctatagagtctatgctgtgtgtaaaatataagacattttttacaactagtaagcttttatgatataaggtgatttcatatgaagcattcttttttttttttccttcagacaaatgaggcctacatgtaatttgctttacgtagtgagcttggcactgctctagacatcagagataaagaggttaataagacagataagatgctactttttgatttgtaatttcttcatataaggcacagccctggcttaggttctgacacagttactgagatcacctacatcacactgagagaactagtgatatcttttaataatcctgtagtcctttgttcttttgcagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380604 - DNA, 4987 bp, Homo sapiens
  misc_feature (4711)..(4711): n is a, c, g, or t
gacaaaagaaacttccctaatctcactacccgaagatttagggacattttttggtgttttctctttttccttcagtttcctttggtaactgtagctaaatactgagtgatttgttctttagtttgccttaaaatattgactgtttccacaagcttgtgttttcattgttgttgtacagaactaggtgcaaatgacacagattaataaaaggttggaaatatgttcttttctctcctctttaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380605 - DNA, 2400 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacacttggatcccagaacacccgatcaaaacacaacaccaccttgtaaggttgccaaatcccatcctttggactgcagatgtttggta

SEQ ID NO: 380606 - DNA, 4767 bp, Homo sapiens
  misc_feature (4491)..(4491): n is a, c, g, or t
tcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380607 - DNA, 2191 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaagggtgtggtttgacggtgcttggaccaggcattgtcgctgtgcagacatgcacag

SEQ ID NO: 380608 - DNA, 4149 bp, Homo sapiens
  misc_feature (3873)..(3873): n is a, c, g, or t
atgtgtggtgttctagaggatcccatcgtgcaggtagaggcttactagaagtgtgaaaacgtaggctggattaaggcgacaggatttctaggatagtcagtagaattagaatggtgaagatgataagtgtagagggaaggttaagggttgatattgctagggtggcgcttccaattatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380609 - DNA, 1235 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaagtaaggacctcctacctggctgataaattttacatttttaagttacggtttcaggactgtattttatatctatgatgacgttaggattttattttgattcataagactatatttaaaaatatttccaagtttatcttcttaaagtcaagttaaatataataaataaataataaaaaatatagtctcttaataaatgtgcatttcccttaatttctagtttgatagctacttagtaaaagatactggatttccaattt

SEQ ID NO: 380610 - DNA, 734 bp, Homo sapiens
gagagcctttctccgtaagatctgatatttggataaagatgtaatagatggaaattatctttcttgagagggtagaagttgctgttgctttacacttccataattttggaaactagcggggtattatactttatttccactgggtttttgacagtgaatgctggtgaaatgttttcacttgcgtccagcctccacataaatctgttctgttcgtgtattcaagaatgcccccaactgtaacttgtctccaaaaacaaaaatctctcagctctatctaaccccagcctaaaattgagccacacttcctgtacatgatctgaagaggaaatatgatccagaccttatactttgtggtacaaagaaactaggtggatatctgacccttcagggtaactcaggttcacttaatttttatcaggaatatgatgaattagctgaaacacaaggaaagctagaagaaaaacttcaggagttggaagcgaatcccccaaggtaaggaaaacaaacacaaaagttcagagggagagcttttactgttctttcagcttgatttggaaggaaaattctaaatcataatgagcttttatttatgttcagtgagtggtttaaattgttaaataaatgaatgtgtgactacttttgaggtttctaaatcccctgctcctgtattttaatgtgtcctagatacctaaacagattgtttctaaagagagagcctttctccgtaagatctg

SEQ ID NO: 380611 - DNA, 347 bp, Homo sapiens
agagacagggtcttgctgtgtttcccaggctggtcttgaactcctggcctcaagtgatcctatcacttcagtctcccaaagccactaagattgtgtgcatcagccaccgtgcccagccttagaattacttttttaaaggagtcacatgacttgaagcttaatggttttaaggacttcatgatggagaaatggaagagttagaagaatattgtttaaactgctgaaaataaaaccgtgtttttaatccacttattctgtaggtgatactgtgcttgtccaccgagttcacagttatttagagcgtcatggtcttatcaacttcggcatctataagaggataaaacccc

SEQ ID NO: 380612 - DNA, 356 bp, Homo sapiens
ttcagagcaccaggaataaggtggggcctgataaggaagtttttgaggaaagtctgtaggaaaaccctagaattatcctttctgtttccccagctccaatactgttggcactagtggcaggagaagctgctggtatcatggaaaacataagtgacgatgtgattgttggccgatgcctggccattctcaaagggatttttggtagcagtgcagtacctcaggtaagtaggtaggtggggcaaggagggatctagggttcagactcaaccagggtttaatgtatttgcagcatgttcttggtcaggacagtttaagctagaattgaggtctgtgcttttacatgaataattaatgtt

SEQ ID NO: 380613 - DNA, 6621 bp, Homo sapiens
  misc_feature (6345)..(6345): n is a, c, g, or t
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcggggcaagcaggaggacttcaagacgacagttctggagggtatggagacggccaagcatcaggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380614 - DNA, 5935 bp, Homo sapiens
  misc_feature (5659)..(5659): n is a, c, g, or t
tcactatattgcctaagctggtctcaaactcctgagctcaagtgatccacccacctcggcctcccaaagtgctgggattataggtgtgagccactgcagccagctaaaagatgattttaaagatggtcagataacatatgtctatttgtatgtaatacaatttatgtcatttaaatgcagctgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380615 - DNA, 5349 bp, Homo sapiens
  misc_feature (5073)..(5073): n is a, c, g, or t
gagagcctttctccgtaagatctgatatttggataaagatgtaatagatggaaattatctttcttgagagggtagaagttgctgttgctttacacttccataattttggaaactagcggggtattatactttatttccactgggtttttgacagtgaatgctggtgaaatgttttcacttgcgtccagcctccacataaatctgttctgttcgtgtattcaagaatgcccccaactgtaacttgtctccaaaaacaaaaatctctcagctctatctaaccccagcctaaaattgagccacacttcctgtacatgatctgaagaggaaatatgatccagaccttatactttgtggtacaaagaaactaggtggatatctgacccttcagggtaactcaggttcacttaatttttatcaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtggtgttgtgttttgatcgggtgttctgggatccaagtgtcaatttgttcgggcatgttggcagtacgactgccagcaggggtgagctcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380616 - DNA, 4376 bp, Homo sapiens
  misc_feature (4100)..(4100): n is a, c, g, or t
cggtataggctgaaggcgaactcagccaggttgggggtgatcttcctcttctggaacctctataaagctccaatactgttggcactagtggcaggagaagctgctggtatcatggaaaacataagtgacgatgtgattgttggccgatgcctggccattctcaaagggatttttggtagcagtgcagtacctcagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttgttttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggatgcttaaagtctaaaatgggtccacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttcccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagccncctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgca

SEQ ID NO: 380617 - DNA, 2429 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcagtgcgacaggttcgctacacggcttcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcaga

SEQ ID NO: 380618 - DNA, 1987 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggatgatgactttgagttcactggcagccacctgacagtaaggaatggctactcgtgtgtgcctgtggctttagcagaaggcctagacattaaactgaatacagcgggtattcacagctatcacttcacatcctgaccccgtgtagcgaacctgtcgcactgctggtcgacc

SEQ ID NO: 380619 - DNA, 2102 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgaatttgctaatgccacacctctctcaactctctcccttaagcactgggatcaggtaagtttcccttattgtttattttattgcacatgtctttgggagggattgtaagagaaatagttaattttgtatgtgtgtttttaaacagctttagtaagagacatcatttacatacagtgaaattcacctattttaagtgaacagtttattgatttgccagacttcagtcataagcccccacacaatcagaatatagaacatgcccatcatcctgaaatgttttctcctgcctctttgtagttaatcccccatgctctggctcctggccctggacaaccactga

SEQ ID NO: 380620 - DNA, 2190 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagaagcttcccccaccaccccctcaagccccacctgaggaagaaaatgaaagtgagcctgaagaaccatcgggtgtggagggcgcagctttccagagccgacttcctcatgaccggatgacttctcaagaagcagcctgttttccagatattatcagtggaccacaacagacccagaaggtttttcttttcattagaaaccgcacactgcagttgtggttggataatccaaagattcagctgacatttgaggctactctccaacaattagaagcaccttataacagtgatactgtgcttgtccaccgagttcacagttatttagagcgtcatggtcttatcaacttcggcatctataagaggataaaacccctaccaactaaaaagacaggaaaggtaattattataggctctggggtctcaggcttggcagcagctcgacagttacaaagttttggaatggatgtcacacttttggaagccaggatcgtgtgggtggacgagttgccacatttcgcaaaggaaactatgtagctgatcttggagccatggtggtaacaggtcttggagggaatcctatggctgtggtcagcaaacaagtaaatatggaactggccaagatcaagcaaaaatgcccactttatgaagccaacggacaagctgttcctaaagagaaagatgaaatggtagagcaagagtttaaccggttgctagaagctacatcttaccttagtcatcaactagacttcaatgtcctcaataataagcctgtgtcccttggccaggcattggaagttgtcattcagttacaagagaagcatgtcaaagatgagcagattgaacattggaagaagatagtgaaaactcaggaagaattgaaagaacttcttaataagatggtaaatttgaaagagaaaattaaagaactccatcagcaatacaaagaagcatctgaagtaaagccacccagagatattactgccgagttcttagtgaaaagcaaacacagggatctgaccgccctatgcaaggaatatgatgaattagctgaaacacaaggaaagctagaagaaaaacttcaggagttggaagcgaatcccccaagtgatgtatatctctcatcaagagacagacaaatacttgattggcattttgcaaatcttgtcataggttcgcaggggccacttgaaggacaaggaaggttggttgaaggtagttgtgtccctgccccttcttcatccatcaactgcccttccccaggctgcctataattcatccattagagaaggaaaaatcaatatttaccaacataaattaaaacccaggcagggaacaggcagagtataggcagggcctgggagcagagagtggctccgtgggcagccaggtggtagcccatgcacattgggacccggggatgctcaggtgacagaatggagcaggtgggccttctggtccagcggcctctgagaccccaccagagcaagcctgtctcctctcctgcagcgtcctccgtagagagcacggagaccccctcatcgaggagctcatcccggcgacgcttggacctgagggcggggccagttagggc

SEQ ID NO: 380621 - DNA, 798 bp, Homo sapiens
tgtcccggcgcggcgggagcgcgcttggcgcgtgcgtacgcgacggcggttggcggcgcgcgggcagcgtgaagcgaggcgaggcaaggcttttcggacccacggagcgacagagcgagcggcccctacggccgtcggcggcccggcggcccgagatgttatctgggaagaaggcggcagccgcggcggcggcggctgcagcggcagcaaccgggacggaggctggccctgggacagcaggcggctccgagaacgggtctgaggtggccgcgcagcccgcgggcctgtcgggcccagccgaggtcgggccgggggcggtgggggagcgcacaccccgcaagaaagagcctccgcgggcctcgccccccgggggcctggcggaaccgccggggtccgcagggcctcaggccggccctactgtcgtgcctgggtctgcgacccccatggaaactggaatagcagagactccggaggggcgtcggaccagccggcgcaagcgggcgaaggtagagtacagagagatggatgaaagcttggccaacctctcagaagatgagtattattcagaagaagagagaaatgccaaagcagagaaggaaaagacaattcctctccccctgaacctcaggcccaccttgggctcatgcctggctcctctctttctctcattccacatcccatccacaagcacagccttgttagtccatcaaatgagaccccaaatgtaatgctctcaccacctgggtccaaaccactaggcttacctggactattgcagcagcctccaagctgcccttc

SEQ ID NO: 380622 - DNA, 454 bp, Homo sapiens
ggcttcaaagagcaactggataaagattttcaataatagcaatgcagagatgacctgggtttcaagataggaggcctttggagccttcagagaattgtcatagaaatgatcagtaactaattgctcagttgccacctcaagttgttgtttccatcttatgcgggagagattcgggggaaatggcaccctgccattttttgtgtgtggtcctgaatcatcctgttggtaaaactcctgaggtcgtctgagctggagttctgattgcttctgtttctctcatagttgcttccccgtctattctgtcagcgtctgtatggggagaggcagtggggagggcgatctcgtccccttgaagtcaatgaccacctgcttttaaggttctcgtatcttttgctctgaaaaaggtgtgggggaggaaaactttcattttccagcgaaagtagaaagggagaga

SEQ ID NO: 380623 - DNA, 523 bp, Homo sapiens
ccctatacactttcttttcaatacatgactgaatggttcaatggttcattttgatatccttgactgtctttcctggctagtcattttcattccatagcttagcacctcatattatatcaatcatttcatagccacttgtgaacacaggtaagaatgatttgcctttccacagcctttgggctgtctcatggagctgaagaaaaatacatgcattcaggggcactaaggaaaaggtccatagcaaaaattcagatctttagtggagatccctgaaggactagaagagtaagggcttaccagaaatattctggtctcataagaactgatgctcaactttgaaggggcttagctgtacagtattaaagttatctgttctgtaccaactgccaaaaaaataaactgtcttgtaggaagaaaacattatctacatcctcaaagtactttggtactttgtaaaccatgtccaatattttattttaaaaatcacctagcatgcaaagaaatatgaccaatgaatgaaaat

SEQ ID NO: 380624 - DNA, 627 bp, Homo sapiens
gagaactgaatgggtgtattctttgatacctagttaaccagttggtgcttaacaggagaatttttcattggagaattgctaccaggtaacattttggtgagtgaaaaggaggccctttggtacaggtatttgactagagacattgcttctacaatttcttagtcattgtgaaaaatcacatatttaaatgggattatttaaatttttaaatactgtatagtatttgtaggcaggtatagtttttatctttatttggtgttttatatgcagttatttaagttctgaaaatgaccatataatttgaagacaacttatttgacggaatgtttgaaatgaagtttgttgaggggcttttgtttgatttagcgaatgggatacagtgttgaatgatgtcctaagtggtaacagccattttcccttaaaggaaaacttgctgtgagctcttagaaagcatgtattctactgtttcaaaggtttcttggttttaacactcaaaaaataaggtgaggccaggtgaggtggcttacgcctgtaatcccaaaactttgggaggctgaggcaggagaatcacttgaggccaggagttcaagaccagcttgggcaacataatgagaccctgtctctacc

SEQ ID NO: 380625 - DNA, 253 bp, Homo sapiens
gccctcaagcttgggcgagattccatttcaaaaaaaaaaaaaagaaagaaaagaacacacatctgtatcaaagaaaatagaaatggccaccaagcatataaaagaaaaatcagggccgagcacattggctcacgcctgtaatcccaacactttgagaggccaaggcaggcaaatcacaagggcaggagttcaagaccagcctggccaacatggtgaaatccctctctactaaaaacagaaaaaattagctggg

SEQ ID NO: 380626 - DNA, 363 bp, Homo sapiens
tttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcctacaaagcttaatggcccatcttgttttagaaaataacagcttatttgttatccacatccttcatctgaggcatcctgccttggccttaaccattgcctggtatgtctccagaactctttattttcttcccaggggcctgggacaggtagtt

SEQ ID NO: 380627 - DNA, 506 bp, Homo sapiens
attcaaagtaactgaagtcagtaggtactttaatttgggtgagccaaacaggcttccagcccagggttgggaactggttttatcagccaagaattgtgttaacccagcctggttcctgtctgattgaattagcataatgctatctcctcgaaccaattctcccaaatttctgtacttccttttacagatcagagtaataacttgggcactagtaggagaggcagcaagtgacttttccttcatgtctgttgcacatgaatgttgcttataagcttccagatgcttatagctttttataatgggacagtccaataatatgcagatgtactgaaaatagtatgatgaggtcccatgtatccctcatccatttcaacaattacgaactcatggccaatcttgttacatgtacactctacctacccccatatccaacccttgacaaccaagacgtagaatttcacttggaaatatttcagtatgtatcttcaaaagataaggactcttaa

SEQ ID NO: 380628 - DNA, 347 bp, Homo sapiens
ttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttattcaatgcaggagaatcgcttgaacccaggaggcggaggttgccgtgagctgagattgcaccattgcactccagcctgggcaacaagagtgaaactctgtctcaaac

SEQ ID NO: 380629 - DNA, 3387 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380630 - DNA, 3285 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380631 - DNA, 3342 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380632 - DNA, 3693 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtgagtgggctttaccagtcagtaggttcattttctcctactcttcattgttggtgactggaaaaaagtctgagtaggcttctgtggaactgctggtattagttcttactacctttagttacttagagtaagttccctccctgcacttctggagaatgtcagtaattgcaccttattccttttggacaggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380633 - DNA, 2529 bp, Homo sapiens
ttttgtatttttagtagaggcagggtttcgctatgttgcccaggctggtctcaaactcttgacctcaagtgacccacctgcctcggcctcccaaagtgctagcattacaggcgtgagccactgcacctagccttaccacccattttttatatatgttgtgtgttctagtgctttggttcattcctaacttggaggaagatcttaagtaaggttagagtaaggatatagatgatgaacttattcaatgcaggagttgctctcatcctttgagaccataagaattttcttagttgagtcttcaagtagctattgcttcttatttatgtgctttcttcttacttcattttgtgtacctctttatatgttaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380634 - DNA, 2260 bp, Homo sapiens
  misc_feature (16)..(16): n is a, c, g, or t
  misc_feature (30)..(30): n is a, c, g, or t
  misc_feature (45)..(45): n is a, c, g, or t
  misc_feature (63)..(63): n is a, c, g, or t
  misc_feature (79)..(79): n is a, c, g, or t
  misc_feature (99)..(99): n is a, c, g, or t
atttactcctagaaantgcccctgggctanccctaaaaaggtgtnaaggcatgggagttgtanaatttcactgtagtcnccaacttgggcttccatttngtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380635 - DNA, 4372 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttatgggacacgagtgggtttggctggattctgaacaagatcatcccaatgactctgagttgagcaatgactgcaggtccctcttcagctcatgggactccagtctggatcttgatgtgggcaactggagggaaactgaggatccagaggctgaggaactagaggaaagcagcccggagagagaacctagtgaactgcttgttggggatggaggcagtgaggaatctcaggaagcggcaaggaaagccagccaccagaacctcctccactttctctctgaggtagcttatttaatggagcccttgtgcatcagcagcaacgaatcaagtgaaggctgctgccctccatctggtaccagacaagaaggaagggaaattaaagctagcgaaggagaaagggagctctgcagagagactgaagagctttcagctaaaggagaccccttagtagctgaaaagccactgggagaaaatggaaagccagaggtggcttcagctccctcagttatttgtacagttcagggactactcacagagagtgaagagggggaggctcagcaagaatccaaaggggaggaccagggtgaagtatatgtgtcagagatggaagaccagcccccttcaggcgagtgtgatgatgcctttaacattaaggagactcccttggtggatacacttttcagccatgctacctcctcaaagctgactgatctaagccaggatgaccctgttcaggatcatttgctatttaagaagactctcctgccagtctggaagatgattgccagtcacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcgagaagtcctggagcagattcaggtactgaatatctggttagacaaaagaaaaggctcaagtagtctggaaggagaaccagctaacccagtggatgatggaaaacctgttttctaacctggagctgctatcctgactttttctagagtttgaatctctcccggaactctgacctagagaggatcctggtacttctttgccatgtcctcattttcttttccaacaagaataataccttaactcacaaccaacgagtcaaagatgcatgtggacataatataaagaaaaaaaggggaagctgaggtttggatttatgccataaatgttgcccacatctttgttccatcggcttgatttaaagacaattccattagatcttttctaagccttttactctataaataaatgtatttacacaataaaaatattgctttttaatgacta

SEQ ID NO: 380636 - DNA, 3681 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380637 - DNA, 3757 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctcttttgactctggatcccccaagcaaagcatttggctggctattgcaaggctggttaatgggatcttttatctattgaagacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380638 - DNA, 4260 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttatgggacacgagtgggtttggctggattctgaacaagatcatcccaatgactctgagttgagcaatgactgcaggtccctcttcagctcatgggactccagtctggatcttgatgtgggcaactggagggaaactgaggatccagaggctgaggaactagaggaaagcagcccggagagagaacctagtgaactgcttgttggggatggaggcagtgaggaatctcaggaagcggcaaggaaagccagccaccagaacctcctccactttctctctgaggtagcttatttaatggagcccttgtgcatcagcagcaacgaatcaagtgaaggctgctgccctccatctggtaccagacaagaaggaagggaaattaaagctagcgaaggagaaagggagctctgcagagagactgaagagctttcagctaaaggagaccccttagtagctgaaaagccactgggagaaaatggaaagccagaggtggcttcagctccctcagttatttgtacagttcagggactactcacagagagtgaagagggggaggctcagcaagaatccaaaggggaggaccagggtgaagtatatgtgtcagagatggaagaccagcccccttcaggcgagtgtgatgatgcctttaacattaaggagactcccttggtggatacacttttcagccatgctacctcctcaaagctgactgatctaagccaggatgaccctgttcaggatcatttgctatttaagaagactctcctgccagtctggaagatgattgccagtcacaggttcagcagtccatttctgaagcctgtgtcagaaaggcaggccccagggtacaaggatgtggtgaaaagacccatggacttaactagcctgaagagaaatctctctaagggtcggattcgcaccatggcccaattcctgcgagacctgatgctgatgttccaaaatgctgtaatgtacaatgactctgatcatcatgtataccatatggctgtggagatgcggcgagaagtcctggagcagattcaggtactgtatgcagatacctgtagcctctggaatcttgatttcagaacgcctatgagaataaaggtgatttcgaggtgaaaaaattctca

SEQ ID NO: 380639 - DNA, 3301 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttaacaaaacaaataaatatccaagactgcaagattacttcatcttccacaggtttgcatgtacaggcatacctcggagatagtgtgcacttggttccagaccattgcaataaagtgaatactgcaataaaatgagtcacaccaattttttcggtttcccagtgcaaagt

SEQ ID NO: 380640 - DNA, 2468 bp, Homo sapiens
  misc_feature (2450)..(2450): n is a, c, g, or t
  misc_feature (2456)..(2457): n is a, c, g, or t
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggagcccggtccgaagagacccncagggnncctctagagtc

SEQ ID NO: 380641 - DNA, 868 bp, Homo sapiens
attgtttcttgggttaagtgcatgttttgggataaggggttagcatttaagtcctggcagctgggagttaaggtatatatgagaaagtctatatgataatgtattcatagatctaggtgcgtcctctttccatccccactgctacttacccctgttcttttttttttaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380642 - DNA, 2157 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtaagttaccacttttcctttatcaacctcaaaggtgttgaacttgacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccgtacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttgtttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaa

SEQ ID NO: 380643 - DNA, 1036 bp, Homo sapiens
cccagcaaaggtttcagtaattcatcttgcctacaggctgtaccacagacagaacattataatctccgttctttcttattggcctacaacagtgactctggatcccccaagcaaagcatttggctggctattgcaaggctggttaatgggatcttttatctattgaagacagcaaaatattgcacaagaggaaggagctgggctgcagggagagagcagcagatggaaagaagccttctaattgtcctgatctcatggaagcctttcttatagggaccaacagttggacaggtatgttagtcaagaacctcactacccattgcccattctgactctcctacctttcttttactctcctgctcctttgcacatgatttgggcctgggtgggatgactaatagttattctgtgggaccctaggtgaattccaaggacctctgtagtgggcatgagcaagatattccatcctacatttcctctcacaaactaccaggtgttctttagccactctgtgggaagacagaaatatgcccctcatccctctggatttttctgctgattctcttccctctcccccaagaaaccaaatccccaacttttctgttgcaccgtctcttgtctcctgaccaactcatgctccctttctttctctgcctgtcatctaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380644 - DNA, 151 bp, Homo sapiens
tgcttggacagaaagcaactccacccccctcccctctgctgtcagagctcttgaagaagggcagcctcctgcctactagccccagactggtatggagacttctgtgggtgtttgagagctgtggtgatttagtacttggaagggagtgcct

SEQ ID NO: 380645 - DNA, 486 bp, Homo sapiens
cactttgggaggctaaggcaggaggatcgctggaacccaggagtttgagaccagcctgggcaacacagtgagaccctatctctacaaaaaaattaaaaaattagctgggcatggtggtatgcacctatagtcccagctacttgggaggctgaggtgagaggattgagtctgggaggttgagggtgcaatgaacatgatcatgccactgcactccagcctgggggacagagtgagaccctgtctcaaaaagaaaagagaattataatttttattttttaacttgtgcctagtggaattgctgtatctctgtttcagctctgtctgtagtgaggatcaggaagctattcaggcacagaaaatttggaagaaagccatcatgcttgtatggagagctgcagctaatcataggtgagtgggctttaccagtcagtaggttcattttctcctactcttcattgttggtgactggaaaaaagtctgagtagg

SEQ ID NO: 380646 - DNA, 387 bp, Homo sapiens
tatagacggctaaagagagatgcagaactaattcaagctggacacatggacagcagactggatgagctttgcaatgacattgcaacgtgggttatattatattgttcttctgtgcttctttctttttaccctcttttcccctcaagtaatctggcttatttcctccaattgccgtccctttagacttgagacagattctggaaggggaaagctgcaaagtggtttggtggctgggaggggggagtgagtcctagaaggtaatataatgggacatttcagtatgaaaacataacttagttctaacttaagagtggctatagtttgcctgggtgaagaactgggagttaggcagtataccccaattcactgttttgctggttagaattc

SEQ ID NO: 380647 - DNA, 3173 bp, Homo sapiens
ggcacgagggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380648 - DNA, 3504 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380649 - DNA, 3206 bp, Homo sapiens
  misc_feature (14)..(14): n is a, c, g, or t
  misc_feature (78)..(78): n is a, c, g, or t
  misc_feature (133)..(133): n is a, c, g, or t
  misc_feature (136)..(136): n is a, c, g, or t
  misc_feature (164)..(164): n is a, c, g, or t
  misc_feature (169)..(169): n is a, c, g, or t
  misc_feature (177)..(177): n is a, c, g, or t
  misc_feature (182)..(182): n is a, c, g, or t
  misc_feature (190)..(190): n is a, c, g, or t
  misc_feature (216)..(216): n is a, c, g, or t
  misc_feature (227)..(227): n is a, c, g, or t
  misc_feature (231)..(231): n is a, c, g, or t
  misc_feature (246)..(246): n is a, c, g, or t
agggtggttcggtngggaattgcgggatggaggggaacggggaaagacaaggtggtaagacgtggggcggagagcagnggtcatccgagagagggtttgttttgatcttttgtattgagaaggtggggagatnaantttgggtttagttggaggaggagattanaggcnctttgcangaacntgggggcnctccaggaatatggttttttcaaaanatcatttgtgntttncaggttctcggaggnttttatgaggaccactgagagagaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380650 - DNA, 2363 bp, Homo sapiens
agtgagtccctagaggatcttattatctgttcgatggcagatgggttactggacttagatttccctgtatcactgtaggtcataactccaagcttttcactcattccaaatttggtaaccatccgcttgctattttagtggcattatcaaaatcactggaagcacctgttgcaatatggtcggttccaaatataagctcctcgtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380651 - DNA, 4131 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatcctgaagtgctggatgtggcagcagtggaagcagcactgtcattttgtgaagaaaatgatgatcctcagtccctgcctggcccctgggagcatcctatccagcaggagcgggacaagccagtacctctccctgcaccagaaatgacggtcaagcaagagagactggactttgaggaaacggaaaacaagggaatacatgaactggtggacatcagggagcccagtgcagagatcaaggtggaacctgcagaaccagagccagtcatttcaggagccgaaatagtagctggagttgttccagccacaagtatggagccaccagaactcaggagtcaggacttagatgaggaactgggaagtactgcagctggagagattgttgaagcagatgttgccattgggaaaggcgatgagactccacttacaaatgtgaagacagaggcatcccctgaaagcatgttgtctccatcacatggctcaaatcccattgaagatcctttagaggcagagactcagcacaagtttgaaatgtcagactcattgaaagaagaatcagggactatttttggaagccagataaaggatgccccaggtgaggatgaggaggaagatggtgtcagtgaagcggccagcctagaggagcctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctcttttgactctggatcccccaagcaaagcatttggctggctattgcaaggctggttaatgggatcttttatctattgaagacagcaaaatattgcacaagaggaaggagctgggctgcagggagagagcagcagatggaaagaagccttctaattgtcctgatctcatggaaaaccactgtcaggaggtgctagggaactagtgccagggtcagtctgcaggaaaggcctttcttatagggaccaacagttggacaggtatgttagtcaagaacctcactacccattgcccattctgactctcctacctttcttttactctcctgctcctttgcacatgatttgggcctgggtgggatgactaatagttattctgtgggaccctaggtgaattccaaggacctctgtagtgggcatgagcaagatattccatcctacatttcctctcacaaactaccaggtgttctttagccactctgtgggaagacagaaatatgcccctcatccctctggatttttctgctgattctcttccctctcccccaagaaaccaaatccccaacttttctgttgcaccgtctcttgtctcctgaccaactcatgctccctttctttctctgcctgtcatctaggatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380652 - DNA, 1078 bp, Homo sapiens
gtcagactcattgaaagagatctatatgccccagtgtgaggatgatagatgtgtcagcctaacctaaggaagaggatcaaggagaaggctacttgtcagaaatggataatgaacctcctgtgagcgagagtgatgatggcttcagcatacacaatgctacactgcagtcacacacactggcagactccatccccagcagccctgcttcttcacagttctctgtctgtagtgaggatcaggaagctattcaggcacagaaaatttggaagaaagccatcatgcttgtatggagagctgcagctaatcataggtatgccaatgtcttcctgcagcctgttacagatgacatagcacctggctaccacagcattgtgcagaggcctatggatttgtcaactattaagaaaaacatagaaaatggactgatccgaagcacagctgaatttcagcgtgacattatgctgatgtttcagaatgctgtaatgtacaatagctcagaccatgatgtctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaaggacagtgtcccaatgggctctcctgccttccttctctctctctttgatggaggaaccaggggacgccgctgtgccattgaagcagatatgaagatgaaaaagtgaagcctcagagttaccctctttgagccgaacctaaaataaaagtaaacaagatagagcttgggcttgcgggcccagttccagaggtggaagttacagaagaggaggtacctgggccacacgacatgagctggaaaatctctcttagagagttggagtagcacaattgcctgttttagggcagaaaccatgggctatgttaatgtcctaatgtgtagctagcagatcgtagctagtttgtattgtcttgtcaattgtacagactttttaaaaaaaacaaccaccagtgaaatgtgtgtgtatacaataaactg

SEQ ID NO: 380653 - DNA, 2270 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtaacccccgggactttgccgagtaccccagtcacctcgtttcctgggattcctgacacccttcctccaggctctgcacccttagaagcccccatgaccccagtaacagatgattcaccccagaaaaagatgcttggacagaaagcaactccacccccctcccctctgctgtcagagctcttgaagaagggcagcctcctgcctactagccccagactggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtagatgatcatccaatccagtctctaacctagatgcagatcatttatttaaaagtaccaaacataacccagagtttgtggaatatgggcaacatatatatagccttctgtatttaacgatcttctgcttcttaaccgtaccagttttctatttataactcttatctatccatgatgttttaaagtctccaccttgctgttatttaccaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgt

SEQ ID NO: 380654 - DNA, 1938 bp, Homo sapiens
ttattgcatgactaatcgttgacattcttaagatgaactggatgctgcaacagctgccctcttgggtttaggtgttgttccttcacggaatccatgcctgaatctgcggtatacaatttttaggtgcctcattcgaccagttccggtggtatttcgtcttttagccttggcactccagttatactttctcttgcgcttggcagggtagccacatttgccacaggtcgacttctgaaggtggtaggccttagagccacagcggcggcacaacgtgtgcgtcttattgcgacgctttccaaacgatgacgttcccttcgtctgcaccttcggggccaagatggcgacgggaacgggcaaacacaagctgctaagcactggccccacagagccatggtccatccgagagaagctatgtttagcatcttctgtcatgagaagtggcgatcaaaattgggtatcagttagcagagcaatcaagccctttgcagaacctggccgccctccagactggttctctcaaaaacattgtgcttcccagtactcggagcttttagagaccactgagacaccaaaacggaaacgaggtgaaaagggagaagtggtggaaactgttgaagatgttattgttcggaaattgactgctgagcgagttgaagaactaaagaaagtgataaaggaaacccaggagagatatagacggctaaagagagatgcagaactaattcaagctggacacatggacagcagactggatgagctttgcaatgacattgcaacgaaaaagaaattggaagaagaggaggctgaagtaaagaggaaggctacagatgctgcataccaggctcgtcaagcagtaaaaacacccccccggaggttacccactgtgatggttcgctctcctatagattctgcctccccaggaggtgattatccacttggggacttgactccaaccactatggaagaggctacctctggggtcaatgagagtgaaatggctgtggcttctggccacctgaacagtacaggtgtcctcctggaggtaggcggggtccttcccatgatacatggtggggagatacagcaaacacccaatactgttgcagcctcccctgctgcatcaggtaagttaccacttttcctttatcaacctcaaaggtgttgaacttgacattgactgacctcagtttcactgttactaagcagttgtcagtgctagatttaaagcccaactttttctaacttttttttggagctactttacctggtaaacaatgtagtctccatattataaagccatctatcttcaagatagtgatagccctgattgaccacagcatggatattgagagtaatattgaactgctttcttagggcttgcaaaatcaaggtgctagagatacctaagattatagaatagtggaataagatttggaaccagagaattgggcttgaatctcaggcctgccacacattggttttgtgaccttggataggtaacttagcttttgagcctcagtttccttttttattgtaacatatatacttcacaaggatgtgatgagaatttaatgaggtagaaagtataaagcagggaaataaaaaaagctccatagaataccgtacaaaccttattggtatttgaatggtgttgaacttgggtggtttacaatatgctgaacttcagcagaagcgacagatttattcataccagtttttcgtttcttggtgattaattttcctctgaggaaaaattaccaccctttgttgttgttgttgttgttgtttttgagacagagccttgctctgtcgcccaagctggagtgtggtggcacaatcttggctcactgcaatctccacctcctgcgttcaagcagttctcctgcctcagcctcctgaatagctgggattacagcacccaccaccacgcctagctaa

SEQ ID NO: 380655 - DNA, 369 bp, Homo sapiens
ggaggcagtggaatcttattctgagccaccggggtggggtttaaaaatgttaatgggcatagaatcacccagagaggtagggcagtgagtttaaatgcagattcccaggtctttccctcagagaaattaatccagtaggtctggttgggggcccaggaatctgcatcttattgagctccttgcatagttttgtgggtggtggcctaggactagactttgagaaacactgtaaagggaccatgaaggggctgggacatgctccaatctgattatgatttgggactttccatagttcaaaattcccttgatattgctacagactgtgggcttccgaagttttacccagcactgcttttttctactaatgaa

SEQ ID NO: 380656 - DNA, 159 bp, Homo sapiens
ggaacagatttgaggacatcctccagcacgatcagtctgggagatatgcggaaagaataatcatcttacagacaccatgtacctatcacctggtataagaaagaaatccttagcaataaagacggaaccacgtatgtcctcctcccctcaccctcagag

SEQ ID NO: 380657 - DNA, 636 bp, Homo sapiens
tcaaaaatctttggcatattaagacagcaaaactaaacctgatatttgctctcagccattctgctttaccctgggaacacaaagctttacttctaattttttaagaaagtgtggttttctttttgtaagtatctctttcaggccaaggtgggaagatcacctgaggtcaggagtttgagaccagcctggccaacatggtgaaaccccatctctactaaaaatacaaaaattagctgggcgtggtggtgcacatctgtaatctcagctactcgggaggctgaggcaggagaatgccttgaacctgggaggcagaggttgcagtgagccaagattgctccactgcactccagcctggacaagagtggaactccatctcaaaaaaaaaaagtatctctctcatcaacaggggtttacctatatatctcagggtattctaatagcctaattaaaatatttttcttaagaatatgtgattttaaaacttaattcagtgttcccttaatttaaccacattatttttatttacttttggtaaggattatgtcttttcataaatttaagtgatcgttaagataggctcctttaagttacacaaattcagccagacttatcagaaaatgagtaaggaagagtgaa

SEQ ID NO: 380658 - DNA, 353 bp, Homo sapiens
atttagaacaagatattatactcttaattcatcatccggttaacttttcttctgaaagtaagataaaaacatttctcattctttttgggccattagtacatgaaatagtatattcattacataagtactggagcttttaagctatcaatggaatcttgtttagtcagctaaagcacatgtattacctttttgtatgggtacaaagtgattcaaagcaagatatcttttaatcctctgaggaaaacagttgtatatttttctctggcctgctttccatgttaacatttcttatttcattctgttttcctgtggacttggctctgaccattaagtgatgattaaaaaaaaaaaat

SEQ ID NO: 380659 - DNA, 7866 bp, Homo sapiens
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 380660 - DNA, 817 bp, Homo sapiens
atttttttggaaattcagtgtaacaatctttggcttttaactgaataatttaatccatttggtatttaatgtagctggtgatatgtttagatttaaatctacccatctttgtgctacttgtcctactggttctttcttttcttcacttcttcaggattaatttttattaatcatttgttatcttctgtcggttgagaagttaaaagtctggtttctacatttttagaagataacttagaaattaaaacttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgtagtggcgggcgcctgtagtcccagctacttgggaggctgaggcaggagcattgcttgaacctgggaagcagaggttacagtgagccgagatcatgccactgcactccagtctaggcaataaagtgagaccctgtctccaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactatt

SEQ ID NO: 380661 - DNA, 10965 bp, Homo sapiens
  misc_feature (10452)..(10452): n is a, c, g, or t
  misc_feature (10559)..(10559): n is a, c, g, or t
gggaacggaggctggatctcggaaacctcgtcggcagtgtcattagaggaagatcgcgtgtctcgggatacggattttggaggaaaagcagaataggacaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattcttttttttttttttttttgagacagagtctcgctctgtcagccaagctggactgcagtggcgcaatcacagcccattgcaacctccacctcctgggttcaagcaatcctcccacctcagcctcccgagtagcctgaaccacaggcacatgccatcatacccgactaagtctgtttgttttttgtagagacggggtctcactatgttgcccaggtcggtctcgaattcctgggcccaagtgattctctcaccttggcctcaaactgttgggattacaggcgtgagccaccatgcccagctgagactaccttctggatctgatgaagtattagaaaggagcgggtggcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgggctccaaaccggtagaccagagagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaaatctccactgaagagacagtcataccttgggggtgctcagggaatctaggtatttgcactccaagctggcaagcctgggggcactgaagggaaacaataattggaaatgtcagaaggaaatgtatatggagaaattaatagagaaatgattattttaacatgacacgtaagtgtaaataggacagccaattgaagcagtcctgcagtaggggcaggcattgtcaacggagaggtgagactgaagaccccgagcagcatctgcatatgcggcagcaggacttcagggcatgattccttaagaacaggacatagaagaggggaagcatagtgtcaggaattaagtcagaaaacaccttcagctgtgagtggaagaaagaaaaaattccaggaaagacaacaggatggaatggggcggtgagggctatgagacaagttagacacaaaaatacaataaatgcaggcagcacaaatcaatggagagagatggcagataaaaatggattacttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatgccgccactgcgctccagcctgggtgacagagcgagactccatctcaaaaaaaaaaaaaaaaaaaaaatggattacttggccaggcatggtggttcacgcttataatcccagcactttgggangccgaggtgagtgggtcacttgagctcaggagttcaagaccagcctgggcaacatggtgaaccccatctctacaaaaattagccaggtgtagtggcatgtgcctgtngtctcagctacttgggaggctgaggcaggagcattgcttgaacctgggaagcagaggttacagtgagccgagatcatgccactgcactccagtctaggcaataaagtgagaccctgtctccaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactatt

SEQ ID NO: 380662 - DNA, 4224 bp, Homo sapiens
  misc_feature (3711)..(3711): n is a, c, g, or t
  misc_feature (3818)..(3818): n is a, c, g, or t
accttctacacgctgaatgcagcattttttgacagctagaggagcgggagaaggagcgaaagagaaagagggaggaggaggagcggcggaaacagccgcctgctcccgaacccacagccagtgtgccccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattcttttttttttttttttttgagacagagtctcgctctgtcagccaagctggactgcagtggcgcaatcacagcccattgcaacctccacctcctgggttcaagcaatcctcccacctcagcctcccgagtagcctgaaccacaggcacatgccatcatacccgactaagtctgtttgttttttgtagagacggggtctcactatgttgcccaggtcggtctcgaattcctgggcccaagtgattctctcaccttggcctcaaactgttgggattacaggcgtgagccaccatgcccagctgagactaccttctggatctgatgaagtattagaaaggagcgggtggcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgggctccaaaccggtagaccagagagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaaatctccactgaagagacagtcataccttgggggtgctcagggaatctaggtatttgcactccaagctggcaagcctgggggcactgaagggaaacaataattggaaatgtcagaaggaaatgtatatggagaaattaatagagaaatgattattttaacatgacacgtaagtgtaaataggacagccaattgaagcagtcctgcagtaggggcaggcattgtcaacggagaggtgagactgaagaccccgagcagcatctgcatatgcggcagcaggacttcagggcatgattccttaagaacaggacatagaagaggggaagcatagtgtcaggaattaagtcagaaaacaccttcagctgtgagtggaagaaagaaaaaattccaggaaagacaacaggatggaatggggcggtgagggctatgagacaagttagacacaaaaatacaataaatgcaggcagcacaaatcaatggagagagatggcagataaaaatggattacttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatgccgccactgcgctccagcctgggtgacagagcgagactccatctcaaaaaaaaaaaaaaaaaaaaaatggattacttggccaggcatggtggttcacgcttataatcccagcactttgggangccgaggtgagtgggtcacttgagctcaggagttcaagaccagcctgggcaacatggtgaaccccatctctacaaaaattagccaggtgtagtggcatgtgcctgtngtctcagctacttgggaggctgaggcaggagcattgcttgaacctgggaagcagaggttacagtgagccgagatcatgccactgcactccagtctaggcaataaagtgagaccctgtctccaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactatt

SEQ ID NO: 380663 - DNA, 7225 bp, Homo sapiens
gggaacggaggctggatctcggaaacctcgtcggcagtgtcattagaggaagatcgcgtgtctcgggatacggattttggaggaaaagcagaataggacaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctggggtaggaacagggaacagtgctctcgggatgggaggagagttgggagtgacacaggtgagccatgagtcaggtccagagggaggggagttcctgtaaggagcctgagtggagtaaccaggccagccacttggggatagtgtagatgagggaggcggagattctggttgtctccacaccaagagggagcaggagaaccaagacccag

SEQ ID NO: 380664 - DNA, 5102 bp, Homo sapiens
gggaacggaggctggatctcggaaacctcgtcggcagtgtcattagaggaagatcgcgtgtctcgggatacggattttggaggaaaagcagaataggacaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctcttattgcccaggctggagtagctcttattgcccaggctggagtagctcttattgcccaggctggagtagctcttattgcccaggctggagtagctcttattgcccaggctggagt

SEQ ID NO: 380665 - DNA, 303 bp, Homo sapiens
gcgggtgtgggtgcaggtttgttataagttatattgtgtgatgctgaagtttggggtgtaattgaacccatcacccatgtagtgagcacagtacccaatagggattttttcaacccctgcccttggattcttgtgcatataaagttcgagatccactgatccagcccatgaggggatgctctccctgggtgagctgcagtgatgagcagccacagtgggctggatagagactggttggtgtctctgctgggcatgaaggcggaaatgcagagctaacatgtccttcctcctggcggtttgcag

SEQ ID NO: 380666 - DNA, 446 bp, Homo sapiens
tcacgtgccgggtgggggacctgtacagcgacctccgggacggacgcaacctgctgaggctcctcgaggtgctctcgggagagatactggtgagctgtggtcatgaagggaagtgggggggccttagaaaagtgtccaaggggaccagctggaagaacagccctcagagagagtgacggcacagggcgggaagcagtggctccctctgctcagaggatgggttcatttcaagtgcctttgccacttagattacataggagcattgcttcatggagacaggaacagtggccccattgaaaacatttcttttcccacctactctgggtgcaattaattcccttgggaatcttaatctgcccaagcctcatctgtaagctcagctttggctccagccctggggctgtgcctgtctgtgttcctgaggtaggtcatggggaaggtgtgca

SEQ ID NO: 380667 - DNA, 10672 bp, Homo sapiens
  misc_feature (10159)..(10159): n is a, c, g, or t
  misc_feature (10266)..(10266): n is a, c, g, or t
gggaacggaggctggatctcggaaacctcgtcggcagtgtcattagaggaagatcgcgtgtctcgggatacggattttggaggaaaagcagaataggacaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattcttttttttttttttttttgagacagagtctcgctctgtcagccaagctggactgcagtggcgcaatcacagcccattgcaacctccacctcctgggttcaagcaatcctcccacctcagcctcccgagtagcctgaaccacaggcacatgccatcatacccgactaagtctgtttgttttttgtagagacggggtctcactatgttgcccaggtcggtctcgaattcctgggcccaagtgattctctcaccttggcctcaaactgttgggattacaggcgtgagccaccatgcccagctgagactaccttctggatctgatgaagtattagaaaggagcgggtggcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgggctccaaaccggtagaccagagagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaaatctccactgaagagacagtcataccttgggggtgctcagggaatctaggtatttgcactccaagctggcaagcctgggggcactgaagggaaacaataattggaaatgtcagaaggaaatgtatatggagaaattaatagagaaatgattattttaacatgacacgtaagtgtaaataggacagccaattgaagcagtcctgcagtaggggcaggcattgtcaacggagaggtgagactgaagaccccgagcagcatctgcatatgcggcagcaggacttcagggcatgattccttaagaacaggacatagaagaggggaagcatagtgtcaggaattaagtcagaaaacaccttcagctgtgagtggaagaaagaaaaaattccaggaaagacaacaggatggaatggggcggtgagggctatgagacaagttagacacaaaaatacaataaatgcaggcagcacaaatcaatggagagagatggcagataaaaatggattacttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatgccgccactgcgctccagcctgggtgacagagcgagactccatctcaaaaaaaaaaaaaaaaaaaaaatggattacttggccaggcatggtggttcacgcttataatcccagcactttgggangccgaggtgagtgggtcacttgagctcaggagttcaagaccagcctgggcaacatggtgaaccccatctctacaaaaattagccaggtgtagtggcatgtgcctgtngtctcagctacttgggaggctgaggcaggagcattgcttgaacctgggaagcagaggttacagtgagccgagatcatgccactgcactccagtctaggcaataaagtgagaccctgtctccaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactatt

SEQ ID NO: 380668 - DNA, 8211 bp, Homo sapiens
gggaacggaggctggatctcggaaacctcgtcggcagtgtcattagaggaagatcgcgtgtctcgggatacggattttggaggaaaagcagaataggacaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagggccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 380669 - DNA, 3392 bp, Homo sapiens
  misc_feature (2879)..(2879): n is a, c, g, or t
  misc_feature (2986)..(2986): n is a, c, g, or t
cacgaggcagcaaagacggcagagaacgagagcgagccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcaccgcctctgggtgtctttgctttcctgaccacagcctctctgcccaagcctgtgtcctctccttccgttctggtctccttcatctcacgtttccccagcctccaagctcttgaagagccgtgtcacactgagagcttccctgacctggtctcatttccctctgacagtgacctccagtgtgctgggttgaccaatgccaagcctctttttaaaccaaagtagttcaccatgggttgggatgatgtcaacaagcagtattcatgttaaaaagcaatgagggactccttccctggtgcacaattttcttcacttgtgatctctaaactgttttcaaattggaagactgggaagcattgctacagccccagccagtctcagccactgctcagcccagtggtggaaagctgagcacacagcgggtgcttactgcccccacttgccgtctgctctccagtagatcaagggacctcagacagggatctgagaagtggcaggttccaataaactgatcaacagaatgaagtcactctgggaagccatgaggtgactttacagcccaagcatgtaaatatacacacagaggataatatatattcttttttttttttttttttgagacagagtctcgctctgtcagccaagctggactgcagtggcgcaatcacagcccattgcaacctccacctcctgggttcaagcaatcctcccacctcagcctcccgagtagcctgaaccacaggcacatgccatcatacccgactaagtctgtttgttttttgtagagacggggtctcactatgttgcccaggtcggtctcgaattcctgggcccaagtgattctctcaccttggcctcaaactgttgggattacaggcgtgagccaccatgcccagctgagactaccttctggatctgatgaagtattagaaaggagcgggtggcttctcctttgtctctggtttggcaatcggagctttcagggcacagtgtttgtctccagatgttgatggaagtgggcactccttggtggcctccaacaggaaaagcgtgttctttcattgtttcctatacacacagacaaccgtttttccaggaaggcagccccatctttagtcattgactgcgggcctatcatcagtcatgacgaagaccgagtgaggtgtgtgcaggcccagaactagcacatcacagccccagagtgggctccaaaccggtagaccagagagcctgcaggataatttcccccttaagatgggtagatttactgttccacagccaacaggtggatacgcgtaactagaacaatctgtcatgggactaagtggaagaatccatcagcactacacagcatcttttcttcaaatacaactgtaaaatctccactgaagagacagtcataccttgggggtgctcagggaatctaggtatttgcactccaagctggcaagcctgggggcactgaagggaaacaataattggaaatgtcagaaggaaatgtatatggagaaattaatagagaaatgattattttaacatgacacgtaagtgtaaataggacagccaattgaagcagtcctgcagtaggggcaggcattgtcaacggagaggtgagactgaagaccccgagcagcatctgcatatgcggcagcaggacttcagggcatgattccttaagaacaggacatagaagaggggaagcatagtgtcaggaattaagtcagaaaacaccttcagctgtgagtggaagaaagaaaaaattccaggaaagacaacaggatggaatggggcggtgagggctatgagacaagttagacacaaaaatacaataaatgcaggcagcacaaatcaatggagagagatggcagataaaaatggattacttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaattagccgggcgtagtggcgggcgcctgtagtcccagctacttgggaggctgaggcaggagaatggcgtgaacccgggaggcggagcttgcagtgagccgagatgccgccactgcgctccagcctgggtgacagagcgagactccatctcaaaaaaaaaaaaaaaaaaaaaatggattacttggccaggcatggtggttcacgcttataatcccagcactttgggangccgaggtgagtgggtcacttgagctcaggagttcaagaccagcctgggcaacatggtgaaccccatctctacaaaaattagccaggtgtagtggcatgtgcctgtngtctcagctacttgggaggctgaggcaggagcattgcttgaacctgggaagcagaggttacagtgagccgagatcatgccactgcactccagtctaggcaataaagtgagaccctgtctccaaaaaaaaaaaataggattatgtagagaaaaatatatttgcattcttaacatcacctacaagagtggactttaggtccatgctgtccacagcagcagccacccagccatgtgtggctactgagatgtagccaaaccaagtgtgtcatgactctgaaacaccaggtatgaagcatggaagaggacaacaactttaaataccttaatttttatattgattatgtgttgaaataatattttagatatattgggtttcaaaagtatcattaaagtgaatttcaactatt

SEQ ID NO: 380670 - DNA, 4545 bp, Homo sapiens
gccaaggttctggggatatttataacttgaagagggtgggagtccctaataagctgctatattctttttccatcacttccctctccaaggctacagcgagctgggagctcttccccacgcagaatgcctgctttccccagtgctcgacttccattgtctaattccctcatcctggctggggaaagggagagctgcgagtcctcccgttccgaggaactccagctgaatgcagcttagttgctggtggtttcttggccagcctctgtggtctcagggatctgcctatgagcctgtggtttctgagctgcctgcgagtctgaggcctcgggaatctgagtctttaggatcagcctacgatatctgggcttcgcctgcaagtctacgaattcgagatctacctgcgggtctgagacctccgggacctgcccgtgctctctagaatcttcctgaacgccaggtctgagagaacgctgcggctctggaacccgttcgcggtctctcaggttttggagacgacgatctagtggatcttttgcgggacaggagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaacttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcctaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtgagccactatgggtatcagcttgggagtggccatagatgaccgcatttccatgacctaactgtatttcacccccttttccttccctactgttcttgccccaccccaaccagttcctgctgctgcttttggcttcttggaggtgaagggcttaaaacaaggcttctaagcacccagctatctccatacatgaacaatctagctgggaaacttaaaggacaagggccacaccagctgtctcctctttctgccaattgttgcccgtttgctgtgttgaactttgtatagaactcatgcatcagactcccttcactaatgctttttgcatgccttctgctcccaagtccctggctgcctctgcacatcccgtgaacactttgtgcctgttttctatggttgtggagaattaatgaacaaatcaatatgtagaacagttttccttatggtattggtcacagttatcctagtgtttgtattattctaacaatattctataattaaaaatataatttttaaagtcagcaaa

SEQ ID NO: 380671 - DNA, 454 bp, Homo sapiens
ctactactaaattcccgaccgcgtcaccccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtga

SEQ ID NO: 380672 - DNA, 949 bp, Homo sapiens
gccaaggttctggggatatttataacttgaagagggtgggagtccctaataagctgctatattctttttccatcacttccctctccaaggctacagcgagctgggagctcttccccacgcagaatgcctgctttccccagtgctcgacttccattgtctaattccctcatcctggctggggaaagggagagctgcgagtcctcccgttccgaggaactccagctgaatgcagcttagttgctggtggtttcttggccagcctctgtggtctcagggatctgcctatgagcctgtggtttctgagctgcctgcgagtctgaggcctcgggaatctgagtctttaggatcagcctacgatatctgggcttcgcctgcaagtctacgaattcgagatctacctgcgggtctgagacctccgggacctgcccgtgctctctagaatcttcctgaacgccaggtctgagagaacgctgcggctctggaacccgttcgcggtctctcaggttttggagacgacgatctagtggatcttttgcgggacaggaggtaagtctgttcgtcccccactcgggttttcggcttcctaccttcaaccggacagggactgctaacatcctgaaggcccgcccggatcagggcctcagacgcccagggtcccttcggtgcgggaggccgctgggagcccctgtagcagacaagccctctgggacgctaaggagggcccgccccccccgcaggggcctggctatctcctccttacacgccctacaccgccacccgcttctgagtcccccagggttttcgcctccccgccgctggacgccactcagcccgccgctcgaggggcgcccccttgagaaggacgcagtcgcacgcccctacagggttaaagcgccgaagccaagacaccgccaggctctactgccgaccgcactcccgagtcgccccg

SEQ ID NO: 380673 - DNA, 450 bp, Homo sapiens
atggcagagcggaggcgttccctgggctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggtaagccggaggtggcttctcagaccttgtctctgcttacccacctcgtccggcgtttc

SEQ ID NO: 380674 - DNA, 4023 bp, Homo sapiens
gccaaggttctggggatatttataacttgaagagggtgggagtccctaataagctgctatattctttttccatcacttccctctccaaggctacagcgagctgggagctcttccccacgcagaatgcctgctttccccagtgctcgacttccattgtctaattccctcatcctggctggggaaagggagagctgcgagtcctcccgttccgaggaactccagctgaatgcagcttagttgctggtggtttcttggccagcctctgtggtctcagggatctgcctatgagcctgtggtttctgagctgcctgcgagtctgaggcctcgggaatctgagtctttaggatcagcctacgatatctgggcttcgcctgcaagtctacgaattcgagatctacctgcgggtctgagacctccgggacctgcccgtgctctctagaatcttcctgaacgccaggtctgagagaacgctgcggctctggaacccgttcgcggtctctcaggttttggagacgacgatctagtggatcttttgcgggacaggagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaacttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcctaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtga

SEQ ID NO: 380675 - DNA, 1183 bp, Homo sapiens
gccaaggttctggggatatttataacttgaagagggtgggagtccctaataagctgctatattctttttccatcacttccctctccaaggctacagcgagctgggagctcttccccacgcagaatgcctgctttccccagtgctcgacttccattgtctaattccctcatcctggctggggaaagggagagctgcgagtcctcccgttccgaggaactccagctgaatgcagcttagttgctggtggtttcttggccagcctctgtggtctcagggatctgcctatgagcctgtggtttctgagctgcctgcgagtctgaggcctcgggaatctgagtctttaggatcagcctacgatatctgggcttcgcctgcaagtctacgaattcgagatctacctgcgggtctgagacctccgggacctgcccgtgctctctagaatcttcctgaacgccaggtctgagagaacgctgcggctctggaacccgttcgcggtctctcaggttttggagacgacgatctagtggatcttttgcgggacaggagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcattcctcgcaacaggggtaccgagctc

SEQ ID NO: 380676 - DNA, 514 bp, Homo sapiens
tctaatcatgtttctaatttcaagaagtcctaaatacagaatagtagggaagtatcgtgtgatttcaggcacctgtgacgtttgaagatatggccatgtatctcacccgggaagaatggagacctctggacgctgcacagagggacctttaccgggatgttatgcaggagaattatggaaatgttgtctcactaggtaagtaaggattctacctttctttgcctccacgtttttgagatcgtgtcaaaatgacttagttctttcaacacagcctagtggtttgattttttaaagcacttaattggatgttggcttgacttgagtcctcaggcagatctttgaatatgggaacatccaggtcatattgtctaaaaagaaaaaaactgcttctgcacgtcttagacgttcagatttcttgtgccctgagtcattttccaatctccagcctgtttgtacagatcactgaccaaacaggtctggcataatagtgcttgccagaatataaatgccccgt

SEQ ID NO: 380677 - DNA, 4297 bp, Homo sapiens
atggcagagcggaggcgttccctgggctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaacttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcctaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtgagccactatgggtatcagcttgggagtggccatagatgaccgcatttccatgacctaactgtatttcacccccttttccttccctactgttcttgccccaccccaaccagttcctgctgctgcttttggcttcttggaggtgaagggcttaaaacaaggcttctaagcacccagctatctccatacatgaacaatctagctgggaaacttaaaggacaagggccacaccagctgtctcctctttctgccaattgttgcccgtttgctgtgttgaactttgtatagaactcatgcatcagactcccttcactaatgctttttgcatgccttctgctcccaagtccctggctgcctctgcacatcccgtgaacactttgtgcctgttttctatggttgtggagaattaatgaacaaatcaatatgtagaacagttttccttatggtattggtcacagttatcctagtgtttgtattattctaacaatattctataattaaaaatataatttttaaagtcagcaaa

SEQ ID NO: 380678 - DNA, 1291 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtcactgacagtgcccagggctctggggtgtctctcacagctaataaagtgtgagacagcttccttgtgtgggactgagaagcaagatatcaatgtagcagaattgcacttgtgcctcacgaacatacataaattttaaaaataaagaataaaaatatatctttttatagaaaaaaaaaaaaa

SEQ ID NO: 380679 - DNA, 1374 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaacggcctctgtggggaggagtgaggggcccgcccggtgggggcgcaggactcagggagccgcgctccggaggagggtctggcgggtctcagcccctcctcgcccccaggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagaaaaaaaaaaaaa

SEQ ID NO: 380680 - DNA, 1602 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagaaaaaaaaaaaaa

SEQ ID NO: 380681 - DNA, 2482 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggcccagctcctgagtgtctctacctctcaaacaagtattctcatccaggagcaattttcccaccagaggacattagctatgtctggaaaaatgttttgttgccatgactggagtgaggaggaggtgctaccagcatcttgtggggaatgaccagggatgctgaacatcctgcagtgcacaagtcagcccaatcacccacataacagataattatccagccccaataccaagattgccaagggtaaggaggcctgccaggactttctctcccttgagtacaagcttccttgaactgagggacaccctgaaggaaaagtgtggtcccaccccagtcatctctcccttccctggagctccatctgtatgcctgtagtgcttaggcctgtaacctggggtccaggaacccaccttcccatgagactgcatgcagaagtgatgatatgtgcacacatgacttcattacagggcattggatattgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaataaatgcatggtgttcccatttaaaaaaactcac

SEQ ID NO: 380682 - DNA, 1273 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcaggtaagatgaaggaggctgatccctgagattgttgggatattgtggtcaggagcctatgagggagctcacccaccccacagtctcagccacttggggccgacaggccgtttgtcacccaacggcccggcgggggcccaccgaaggggagacacggggccctgggt

SEQ ID NO: 380683 - DNA, 1400 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgcctgaattttctgactcttctcagatcctccaaaggcacacgttgcccaccaccccatctctgaccatgaggccaccctgaggtgctgggccctgggcttctaccctgcggagatcacgctgacctgacagcgggatggggaggaacagacccaggacacagagcttgtggagaccaggcctgcaggggatggaaccttccagaagtggccgctgtggtgtgccttctggagaggagcagagatacacgtg

SEQ ID NO: 380684 - DNA, 1522 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatt

SEQ ID NO: 380685 - DNA, 1243 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagatagaaacagagggagctactctcaggctgcagtgtgagacagcttccttgtgtgggactgagaagcaagatatcaatgtagcagaattgcacttgtgcctcacgaacatacataaattttaaaaataaagaataaaaatatatctttttatagaaaaaaaaaaaaa

SEQ ID NO: 380686 - DNA, 2049 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaggctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcaggtaagatgaaggaggctgatccctgagattgttgggatattgtggtcaggagcctatgagggagctcacccaccccacagttcctctagccacatctgtgggctctgaccaggtcctgtttttgttctaccccaatcactgacagtgcccagggctctggggtgtctctcacagctaataaaggtgacactccagggcaggggccctgatgtgagtggggtgttgggggggaacagaggggactcagctgtgctattgggtttctttgacttggatgtcttgagcatgaaatgggctatttagagtgttacctctcactgtgactgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagaaaaaaaaaaaaa

SEQ ID NO: 380687 - DNA, 2811 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcaggtaggaaggggtgaggagtggagtctgagttttcttgtcccactgggggttgcaagccccaagtagaagtgtgccctgcctcattactgggaagcaccatccacactcatgggtctacccagcctgggccctgtgtgccagcacctactcatttgtaaggctcctgtgaaaatgaaggacagattcttcacttcgatgattatggtggtgatgggacctgatcccagcagtcacaaatcacaggggaaggtccctgctgatgacagacctcaggagggcagttggtccaggacccacatctgctttcttcatatttcttgatcctgccctggatctacagttacacttttctggaaacttctctgggatcaaagactaggggtttgctctaggaccttatggccctgcctcctttctggcctctcacaggacattttcttcccatagatagaaacagagggagctactctcaggctgcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttcccatgagactgcatgcagaagtgatgatatgtgcacacatgacttcattacagggcattggatattgatattcatcaggtcagctggggcccaagacactactcttctgccaacaggccgcaatcctctgcattagagagagggtaaagattgagggaggccctaacttcaaaccttctatcactgctagtgaagtgccaaaaagaagtgcaaggtcatctgcccttgtaggaaccacacaggaaggcagagtgtccaccaatgtcaaattccatcaaagaaataatattttgacaaaaaatgcaagtcacctttctaagtcccagacagcagctcaaaataaaaagcattaaacccctcaaatcttagaccaggtgaaattattgaagctgcagtaaggtcttgtgggacctgcagttagagagaagggacaactcaatttgggactgcagcagaaacccctacatcatggggttcctggaagggaccctctcccttcagcgacgcattgtgaggccatttctaggtaaaaaggtagaatttccttggattcctgaggtttattttacacttactgcttattctttgactttatagaagccaacttcagtttgaacatcttgcaattaattttttttggctctaagtggagaatttgaacttgtttctgaagaaaaccaggggctccttatgtgagcaagcaaccctccctgtggcccccttatgcaataaacataagccattgtgagccagcaaaatttaaagcaaggaaagcagtaaaccctccatttcagcatgtttcagcctgtctagtgatgttctagtcttgcctcactcttaacattttaaaatttataattttatttgattttgatttaataagaattcatatgtattcatttcttttgggtttgtcaccaaaagcctcctccaatcacctgtggagtaaagacaagtaaataaatgcatggtgttcccatttaaaaaaactcac

SEQ ID NO: 380688 - DNA, 1489 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcctccaaaggcacacgttgcccaccaccccatctctgaccatgaggccaccctgaggtgctgggccctgggcttctaccctgcggagatcacgctgacctggcagcgggatggggaggaacagacccaggacacagagcttgtggagaccaggcctgcaggggatggaaccttccagaagtgggccgctgtggtggtgccttctggagaggaacagagatacacatgccatgtgcagcacgaggggctgccccagcccctcatcctgagatgggagcagtctccccagcccaccatccccatcgtgggcatcgttgctggccttgttgtccttggagctgtggtcactggagctgtggtcgctgctgtgatgtggaggaagaagagctcagcctactcagtggtcagcggaaacttgatgataacatggtggtcaagcttatttctcctgggggtgctcttccaaggatatttgggctgcctccggagtcacagtgtcttgggccgccggaaggtgggtgacatgtggatcttgttttttttgtggctgtggacatctttcaacactgccttcttggccttgcaaagccttcgctttggcttcggctttaggaggggcaggagcttccttcttcgttcttggcaccatcttatgaaaagggtccagattaagatttttgactgagtcattctaaagtaagttgcaagacccatgatactagaccactaaatacttcatcacacacctcctaagaataagaaccaacattatcacaccaaagaaaataaataattccataatatt

SEQ ID NO: 380689 - DNA, 796 bp, Homo sapiens
gcagttcccaggttctgaaagtcccacgcaccccgcgggactcatatttttcccagacgcggaggttggggtcatggcgccccgaagcctcctcctgctgctctcaggggccctggccctgaccgatacttgggcgggctcccactccttgaggtatttcagcaccgctgtgtcgcggcccggccgcggggagccccgctacatcgccgtggagtacgtagacgacacgcaattcctgcggttcgacagcgacgccgcgattccgaggatggagccgcgggagccgtgggtggagcaagaggggccgcagtattgggagtggaccacagggtacgccaaggccaacgcacagactgaccgagtggccctgaggaacctgctccgccgctacaaccagagcgaggctgggtctcacaccctccagggaatgaatggctgcgacatggggcccgacggacgcctcctccgcgggtatcaccagcacgcgtacgacggcaaggattacatctccctgaacgaggacctgcgctcctggaccgcggcggacaccgtggctcagatcacccagcgcttctatgaggcagaggaatatgcagaggagttcaggacctacctggagggcgagtgcctggagttgctccgcagatacttggagaatgggaaggagacgctacagcgcgcagatcccccagggcacagcgctcgaggtgtgctgttaggctaagagggtgcagggctagacacgaagcttaaactattcatcttattaaaaataaaacccttataaaactcctca

SEQ ID NO: 380690 - DNA, 371 bp, Homo sapiens
ccaagcagagggaaccccttcagaaaggggagccagggtcagtacctttgggccaccatgacctccagccctgctgctccccagttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtcgccctccatgacctttggtttaatgaggcgtcgacc

SEQ ID NO: 380691 - DNA, 2764 bp, Homo sapiens
  misc_feature (2744)..(2744): n is a, c, g, or t
  misc_feature (2746)..(2746): n is a, c, g, or t
cgcgcttcctctcgccaggcctgcgagcttcctcccagcggaccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380692 - DNA, 2857 bp, Homo sapiens
  misc_feature (2837)..(2837): n is a, c, g, or t
  misc_feature (2839)..(2839): n is a, c, g, or t
cgcgcttcctctcgccaggcctgcgagcttcctcccagcggaccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagtgagctgtgaaggtgtgatccagggtcccagggcctttgaagaaaggagtctggcttctggctggcacgtgtgcagggatgtgcttttcattgctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380693 - DNA, 2839 bp, Homo sapiens
  misc_feature (2819)..(2819): n is a, c, g, or t
  misc_feature (2821)..(2821): n is a, c, g, or t
cgcgcttcctctcgccaggcctgcgagcttcctcccagcggaccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggaggtgagctgggccgggcccctgggggggttctgagggactccgaacttgggaacaagaccacctctctgcccccagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380694 - DNA, 1400 bp, Homo sapiens
  misc_feature (1380)..(1380): n is a, c, g, or t
  misc_feature (1382)..(1382): n is a, c, g, or t
tggaggcacaagctatcgtgctaggtacgaggctgggtgttatcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380695 - DNA, 1210 bp, Homo sapiens
  misc_feature (1190)..(1190): n is a, c, g, or t
  misc_feature (1192)..(1192): n is a, c, g, or t
aagctatagcaggtctagttatgaccaggaatatgcgtagtgagcaggatacgtgtatgggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380696 - DNA, 423 bp, Homo sapiens
tgagctgtgaaggtgtgatccagggtcccagggcctttgaagaaaggagtctggcttctggctggcacgtgtgcagggatgtgcttttcattggtgagcttggtgccctccaccctctcagaagcagctgctcttctctctgcattgggtcaggggcaaggaaaaagcagaaaatgttcccattcaccaccgcaggggggccagaccccaaaaggctgagccacacagagtggccctcggcaagggttggaaatttcggggacagaatgcagcttcctccaaacaagtataggtaggggttgagacccaggatccacagtgtgacatggctgccccccaaagggggcagacccacctgggtgcggttctgggctccatcttttgaaggattttaaaaccttgacaggtcatcttcaaagagcc

SEQ ID NO: 380697 - DNA, 2734 bp, Homo sapiens
  misc_feature (2714)..(2714): n is a, c, g, or t
  misc_feature (2716)..(2716): n is a, c, g, or t
cgcgcttcctctcgccaggcctgcgagcttcctcccagcggaccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacacaaaaaaaaaaananaaaaaaaaaaaaaaaaaa

SEQ ID NO: 380698 - DNA, 2716 bp, Homo sapiens
  misc_feature (2696)..(2696): n is a, c, g, or t
  misc_feature (2698)..(2698): n is a, c, g, or t
cgcgcttcctctcgccaggcctgcgagcttcctcccagcggaccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgaaaaaaaaaaaananaaaaaaaaaaaaaaaaaa

SEQ ID NO: 380699 - DNA, 434 bp, Homo sapiens
gcgtgctgtgtgagagggctgcagggcacgtctgacctcggcctggtctgtccttcctgcccccaggggagccttgtggactacctgcggtctaggggtcggtcagtgctgggcggagactgtctcctcaagttctcgctgtgagtgaagcagcctcttggatgggtagggtttgaggggtacctgccctgctatgggagccccagtctgaggggacatgtggctggcctacccccagagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaag

SEQ ID NO: 380700 - DNA, 876 bp, Homo sapiens
ttagctaaaagtgtcagaggctgagtgtttcaggtgctgtcagattatttcagggctttattgctatattgctggtattggcacttccaattttttaaggtagtagtgacttatctagagatacctaacctccaccgttccttttagaaatttgtgtatttgttgtgcagatgacaagcaaccagccatatcttttcgtttgtttcctgcgttccctttaaccatgagtccctaggtgcccaaggcctacaggcagaacttcgctagggtactgtcatggtggacatgagtggtcctgcccatcaggcaccactggaaaggtggctctggtgcccaagctgctcctgtttccctcctgcagggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggatgaatttgttaggcaagagaaagcgaatatggaagcatgaatacttgaaagtgcctggcacatg

SEQ ID NO: 380701 - DNA, 2130 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380702 - DNA, 1889 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgcaaataacacaaaaaaaaaaaaaaaacctcggagggcaatattatgagtggggtgcgggagaacgcagggtctgtgaaagtggaatgggctaaagcttgttcctgaccaagttttttgtccaaggggcgatttgcggggcaccaaaagggggcgataattcgaaagccgggtactgtgaatgagagaaaac

SEQ ID NO: 380703 - DNA, 2210 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctgagctgagatcacgccattgcactccagcctgggcaacagtgttaagactctgtctcaaatataaataaataaataaataaataaaaataaagcgagatgttgccctcaaacttcacctggccccggtcctggtttgctaatggctgtgggtgggggttactgtgggtgatgactgactggatacaaaatcctaagtaagtggcttcatgaaattttgcctaggactggactgtctttcttttaactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaata

SEQ ID NO: 380704 - DNA, 1763 bp, Homo sapiens
  misc_feature (1703)..(1703): n is a, c, g, or t
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgcaacnaaaaaacataacactataactacacaaaaatattacaagacctacctgcttttttccaac

SEQ ID NO: 380705 - DNA, 2190 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgctccaggccaggaacaatgcccgcgtcatcttcaagcggctccctcgacttcttcagcgactcattcttcaactcagcagtgcagaaggcggcgcccggctcccagaggtattcccagacaggcaactatctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380706 - DNA, 2144 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcagtaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaaaataaagcgagatgttgccctcaaacttcacctggccccggtcctggtttgctaatggctgtgggtgggggttactgtgggtgatgactgactggatacaaaatcctaagtaagtggcttcatgaaattttgcctaggactggactgtctttcttttaactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaata

SEQ ID NO: 380707 - DNA, 1840 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcagtccgtgcggccactccagcacacgcagcatgagccactgtgcccggcaagatctaactcacgcttacttttcattaaaatatttcttgtcgcttttagctatggtcagaatccaataaacagcttacgcattcatttgggtaaagcaaatttcacaggaaactagacaaaattataagagattcctggagacaacacaaggaaacacaatgtttaaaagcaaaatagcctgtgtaatgttaggtaatgtaatgcccaagtgaatcacagatttttcgtcaagcaaactactgtttctacttgtgggcggaacacaacagtcaagttttcacattttgtacatttcacaggaacagacacagaaaagcacaaaggtttttcttttctttattaatgggctactagaaatgagcagtgcaagagtctacctgtactattctaatacagtcacgatactggccccacaatggaggtacacttttttaacac

SEQ ID NO: 380708 - DNA, 1549 bp, Homo sapiens
  misc_feature (8)..(8): n is a, c, g, or t
  misc_feature (17)..(17): n is a, c, g, or t
gaaactangctagtagngcccggtgtgaatcggccgaggccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380709 - DNA, 1512 bp, Homo sapiens
  misc_feature (7)..(7): n is a, c, g, or t
  misc_feature (60)..(60): n is a, c, g, or t
  misc_feature (133)..(133): n is a, c, g, or t
  misc_feature (143)..(143): n is a, c, g, or t
tggaganaagaaaagggcaagggattgggaatattttggttgatgatgaaattgattggngaggtttgagaagggaaaaagaaaattagtgatgttggaaaaaataaaagtgggggagaataattagattttnttaaggagantgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380710 - DNA, 1303 bp, Homo sapiens
ttaattaattaccaattcccaccccccaccatttttttcccggggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380711 - DNA, 1651 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaacatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380712 - DNA, 1100 bp, Homo sapiens
  misc_feature (8)..(8): n is a, c, g, or t
  misc_feature (17)..(17): n is a, c, g, or t
gaaactangctagtagngcccggtgtgaatcggccgaggcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380713 - DNA, 1622 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgaatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380714 - DNA, 1191 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgaatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380715 - DNA, 1451 bp, Homo sapiens
  misc_feature (8)..(8): n is a, c, g, or t
  misc_feature (17)..(17): n is a, c, g, or t
gaaactangctagtagngcccggtgtgaatcggccgaggccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380716 - DNA, 1472 bp, Homo sapiens
  misc_feature (8)..(8): n is a, c, g, or t
  misc_feature (17)..(17): n is a, c, g, or t
gaaactangctagtagngcccggtgtgaatcggccgaggccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgaatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380717 - DNA, 1120 bp, Homo sapiens
ctcctgggcattcctgccatgttcgtcgggtgggaattaagtgcagctctgcctgcaggtggtggaaggcctccagtcatggccagccctggctaacctggccttttatctcaggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380718 - DNA, 905 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaaggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagagagctgccaggaggctt

SEQ ID NO: 380719 - DNA, 1699 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380720 - DNA, 2491 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaaaataaagcgagatgttgccctcaaacttcacctggccccggtcctggtttgctaatggctgtgggtgggggttactgtgggtgatgactgactggatacaaaatcctaagtaagtggcttcatgaaattttgcctaggactggactgtctttcttttaactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaata

SEQ ID NO: 380721 - DNA, 2357 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaaaataaagcgagatgttgccctcaaacttcacctggccccggtcctggtttgctaatggctgtgggtgggggttactgtgggtgatgactgactggatacaaaatcctaagtaagtggcttcatgaaattttgcctaggactggactgtctttcttttaactgtgaaatgatgatggttctccctaacgtctcctcaaaggatacaagaaagttgttgttgctagtagaccgaggggtgggaattactgaaatggaaaatctagatgacagtgctggggaagagaaaactagaacagctcagttgaagacaacctttactgcatgttgacgctgatttaggcaatagcttcctaaaaatcatgtataaagttagttagttagacatgaaatctcttccccaatgttgatacctgcccacaaaata

SEQ ID NO: 380722 - DNA, 1808 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgcgacgttaggtcaagggtgtagccatgaggtggaagaaatgggtaattttacgcaagaaaattcgatagcctttagaaagtgagggtcaaagtgggacaagggggaataa

SEQ ID NO: 380723 - DNA, 1679 bp, Homo sapiens
  misc_feature (1657)..(1657): n is a, c, g, or t
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaacgccatggagtcncatacacactctcgaggaccga

SEQ ID NO: 380724 - DNA, 1909 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcctaatactaactacctgactcctacccctcacaatcatggcaagccaacgccacttatccagtgaaccactatcacgaaaaaaatctacctctctatactaatctccctacaaatctccttaattataacattcacagccacagaactaatcatatttatatcttcttcgaaaccaattatccccactgtggcatcatcacccgatgaggcaaccagccagaacgcctgaacgcaggcacatacttcctattctacaccctagtaggtcccttcccctatcatcgcactaatttacactcaagaaaacctaggtcataaacattctactatcagtctcatggcaagaatatcaaatcctgagccaacaattaatatgactagttacacaatagtgtttatagttaaagatactctttaggactccatttatgaatccctaagccatgttgaagccccatagctgggtaatagtattgcgcggaattttaaaataggcggataggata

SEQ ID NO: 380725 - DNA, 1291 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagtccagaatgccccagggatcctctaa

SEQ ID NO: 380726 - DNA, 1490 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggatgaatttgttaggcaagagaaagcgaatatggaagcatgaatacttgaaagtgcctggcacatg

SEQ ID NO: 380727 - DNA, 1516 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagagcgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380728 - DNA, 1395 bp, Homo sapiens
aactggcgcgtggaatgcgagtgcctagtgagaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380729 - DNA, 1975 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380730 - DNA, 1315 bp, Homo sapiens
tactggtagcctccggttaacagctcccgctgcatccgttctggcttaccacatgctctcgttcactactgcatcagtaccactcttccacgtcaactaaacatcctgctcgtaacatcggcgctcctctcaagacgaccagtaagacatagctcctcgagactgggcgtcggagtgcgacgtcgagtctgagcgagaaacctgacacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctcctcattgctgggctccaggccaggaacaatgcccgcgtcatcttcagcggctccctcgacttcttcagcgactccttcttcaactcagcagtgcagaaggcggcgcccggctcccagaggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380731 - DNA, 1516 bp, Homo sapiens
ttagctaaaagtgtcagaggctgagtgtttcaggtgctgtcagattatttcagggctttattgctatattgctggtattggcacttccaattttttaaggtagtagtgacttatctagagatacctaacctccaccgttccttttagaaatttgtgtatttgttgtgcagatgacaagcaaccagccatatcttttcgtttgtttcctgcgttccctttaaccatgagtccctaggtgcccaaggcctacaggcagaacttcgctagggtactgtcatggtggacatgagtggtcctgcccatcaggcaccactggaaaggtggctctggtgcccaagctgctcctgtttccctcctgcagggtattcccagacaggcaactatgaactagctgtggccctctcccgctgggtgttcaaggaggagggtgtcctccgtgtggggcctgtgtcccatcatcgggtgggcgagacagccccacccaatgcctacactgtcactgacctagtggagtatagcatcgtgatccagcagctctcaaatggcaaatgggtcccctttgatggcgatgacattcagctggagtttgtccgcattgatccttttgtgaggaccttcctgaagaagaaaggtggcaaatacagtgttcagttcaagttgcccgacgtgtatggtgtattccagtttaaagtggattacaaccggctaggctacacacacctgtactcttccactcaggtatccgtgcggccactccagcacacgcagtatgagcgcttcatcccctcggcctacccctactacgccagcgccttctccatgatgctggggctcttcatcttcagcatcgtcttcttgcacatgaaggagaaggagaagtccgactgaggggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgctaaaagtggcatttttcctatgtgcagtcactcctctcatttctaaaatagggacgtggccaggcacggtggctcatgcctgtaatcccagcactttgggaggccgaggcaggcggctcacgaggtcaggagatcgagactatcctggctaacacggtaaaaccctgtctctactaaaagtacaaaaaattagctgggcgtggtggtgggcacctgtagtcccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaataaataaaaataaagcgagatgttgccctcaaaacacataaaccaaaacgggcgg

SEQ ID NO: 380732 - DNA, 1335 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttgggatggtggccgatcctgataaccctttggtgctggacatcctgacgggctcttccacctcttactccttcttcccggacaagcctatcacccagtatccacatgcggtggggaagaacaccctccctctcccgctgggtgttcaaggaggagggtgtcctccgtgtggggcctgtgtcccatcatcgggtgggcgagacagccccacccaatgcctacactgtcactgacctagtggtaagagatgtttggggtgggagggcccaaagggtttgccaagctgactgagctcagctcagaagcacttattgaacacttctttgctggcctaaagggcataaataaagatgaataagttaatccctacacctaagcatgccaggtgagatgcagagcctggcgtgaaaactgatgtcctaataggagcacttcttttgaagaggtgtgtgtatttgctatggggggcagcagtgggaggggcttcactgattaactctgcccaggaagttggacttaataagagaaataggtcattaggatgaatttgttaggcaagagaaagcgaatatggaagcatgaatacttgaaagtgcctggcacatg

SEQ ID NO: 380733 - DNA, 926 bp, Homo sapiens
accagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttggcgcggtttgcgccagcggaccccgcaccttagtgctgctggacaacctcaacgtgcgggagactcattcgcttttcttccggagcctgaaggaccggggctttgagctcacattcaagaccgctgatgaccccagcctgtctctcataaagtatggggaattcctctatgacaatctcatcattttctccccttcggtagaagattttggaggcaacatcaacgtggagaccatcagtgcctttattgacggtggaggcagtgtgctggtagctgccagctccgacattggtgaccctcttcgagagctgggcagtgagtgcgggattgagtttgacgaggagaaaacggctgtcattgaccatcacaactatgacatctcagaccttggccagcatacgctcatcgtggctgacactgagaacctgctgaaggccccaaccatcgttgggaaatcatctctaaatcccatcctctttcgaggtgttggctagagccctctccgcacagcgtggagacggggcagggaggggggttattaggattggtggttttgttttgctttgtttaaagccgtgggaaaatggcacaactttacctctgtgggagatgcaacactgagagccaaggggtgggagttgggataatttttatataaaagaagtttttccactttgaattgc

SEQ ID NO: 380734 - DNA, 89 bp, Homo sapiens
attgaactagggaagcagaaaaaaaaaattttccactggttaattattttgataatttggttctaaaaacattaccagtatatatattg

SEQ ID NO: 380735 - DNA, 325 bp, Homo sapiens
actatcttctcaaactgccacaacatcgagaggaaccaaagcagcttttccagtgacaatggccgtgaacaaaacttttatgacttaaaaagaatatagcaggatagcaaatatgaaaattgtaggaggggcaggagagtgactaactcagctaccatgctgcctttctttcctatgcaatttaaaagagttgttacactcacagcaaagagactattacgagccattggatggtattctgtcctaaactgagatgaccaagcaggcttgctggactaagacagtctcagtcagccaccagcacagcaaggccagttactacaag

SEQ ID NO: 380736 - DNA, 3192 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaaaaaaaaaacaacaaaacaaaaaaacaaaacagaagcacacaaccaccacacaacacgaggggccccaaccaagagaccaacccacaaccgagcccacaaacagagggacgcgacacaccgcacacgacacaggcaagagcgggcgcacccacaacggaccgcccgccacgggcagaggcagcgagggacgcacagatacacagaggaggaggcgagagaaaagggaggagaggagagaacaacagaggagggcgaacacgacgcccgcggagacaagcgagggcggccacacccaccaagaggagaccggacaacccgggagaaaacaaccgcgacagcgacaggagggcgccagagaggcagacacagagcgcagcgcggcacagagcgccgcgggagccgccggacgaccagtacaacaggaacagcaa

SEQ ID NO: 380737 - DNA, 2875 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaaggtctgtggctccccagacctctaagtccatctgtgtattcccagggattgaaagggggcaggtgacaggacccctggagcctctcttctctgttcacatggttcccctccctagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380738 - DNA, 2631 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaaggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380739 - DNA, 3148 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggtgaggcgctcaggtggacactgttcccctgactcacccccaccctagcagctgagggaagccggggataaaagaggctgctgaagcatccagcctcgtggtggcctaattggctgtgtgtcaccagcctggcggggctgacctggggtgccctgggagccagggcagggccaggccatggactcaagggtttggattttggggcctgtgtcactccctttccctgcccaaccctccaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagtaagtgctgttatggggtgccttgtattcaggccactaatccagcagggccgcaccctcgtgagtgctcctgggctcaggggtctgggtttctcagaggaggggcattggtgcagggctccctctgacctctgcctccccattctaggactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380740 - DNA, 747 bp, Homo sapiens
ccatcctgatccctctgattcccccttggtggtggttggggttgctgaaagctagaggataaggcatacactaatggggagggggctgtctcacgctggatcagtgacctgccctgatcctgctcccagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380741 - DNA, 2761 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380742 - DNA, 2784 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccaggagttgcgggaaggtctgggaggcccagggtgctggggaggaagctgggcccggagcctaggtcctgaccactgtcatgctctgtgtgcaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380743 - DNA, 2909 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagtaagtgctgttatggggtgccttgtattcaggccactaatccagcagggccgcaccctcgtgagtgctcctgggctcaggggtctgggtttctcagaggaggggcattggtgcagggctccctctgacctctgcctccccattctaggactgtgcactacaatcccaccagcacaaagcacttctccttctccgtgggtgctgtgccccgggccctgcagcctcagctgggtatcctgcggtacttcgcctcctacatggagcagcacctcatgaagggtggagatctgcccagtgtggaagaggtagaggtacctgctccgcccttgctgctgcagtgggtcaagacggatcaggctctcctcatgctgtttagtgatggcactgtccaggtgaacttctacggggaccacaccaagctgattctcagtggctgggagcccctccttgtgacttttgtggcccgaaatcgtagtgcttgtacttacctcgcttcccaccttcggcagctgggctgctctccagacctgcggcagcgactccgctatgctctgcgcctgctccgggaccgcagcccagcctaggacccaagccctgaggcctgaggcctgtgcctgtcaggctctggcccttgcctttgtggccttcccccttcctttggtgcctcactgggggctttgggccgaatcccccagggaatcagggaccagctttactggagttgggggcggcttgtcttcgctggctcctaccccatctccaagataagcctgagccttagctcccagctagggggcgttatttatggaccacttttatttattgtcagacacttatttattgggatgtgagccccaggggggcctcctcctaggataataaacaattttgcagaa

SEQ ID NO: 380744 - DNA, 2625 bp, Homo sapiens
tgcctctccgctgctggctggaacgctgatctatctagttgctggggagacgcccccagatgcccgggccccactcggacttcagcacacatcccgaaggatggggaaagaaagaggcccccacgagcgggactcgcagtggccaaggaggggtgagaggcggacagggatcagctggcccctgcggcctggttgcacctgcatggtgactagctgccgggctgcgccccggggcgcggcgaggaggcggggtctggcagtgcgttgggtgggggaggagcttctgggtgatgtaaggccgggaatgggagtggcctctcctcgactcgctgctaggaagggggcgggactctcggtgaccagacgccggggagggggcaggcgttcattgataaaacgctgggctcccctgggcgccagcgcagcgtagcaaatccaggcagcgccacgcgcggccggggccgggcggaaccgagaagccgggaccgcgctgcgacgcgccggccgcatggagcctgccgccggtttcctgtctccgcgccccttccagcgtgcggccgccgcgcccgctcccccggccgggcccgggccgcctccgagtgccttgcgcggacctgagctggagatgctggccgggctaccgacgtcagaccccgggcgcctcatcacggacccgcgcagcggccgcacctacctcaaaggccgcttgttgggcaaggggggcttcgcccgctgctacgaggccactgacacagagactggcagcgcctacgctgtcaaagtcatcccgcagagccgcgtcgccaagccgcatcagcgcgagaagatcctaaatgagattgagctgcaccgagacctgcagcaccgccacatcgtgcgtttttcgcaccactttgaggacgctgacaacatctacattttcttggagctctgcagccgaaagtccctggcccacatctggaaggcccggcacaccctgttggagccagaagtgcgctactacctgcggcagatcctttctggcctcaagtacttgcaccagcgcggcatcttgcaccgggacctcaagttgggaaattttttcatcactgagaacatggaactgaaggtgggggattttgggctggcagcccggttggagcctccggagcagaggaagaagaccatctgtggcacccccaactatgtggctccagaagtgctgctgagacagggccacggccctgaggcggatgtatggtcactgggctgtgtcatgtacacgctgctctgcgggagccctccctttgagacggctgacctgaaggagacgtaccgctgcatcaagcaggttcactacacgctgcctgccagcctctcactgcctgcccggcagctcctggccgccatccttcgggcctcaccccgagaccgcccctctattgaccagatcctgcgccatgacttctttaccaagggctacacccccgatcgactccctatcagcagctgcgtgacagtcccagacctgacaccccccaacccagctaggagtctgtttgccaaagttaccaagagcctctttggcagaaagaagaagagtaagaatcatgcccaggagagggatgaggtctccggtttggtgagcggcctcatgcgcacatccgttggccatcaggatgccaggccagaggctccagcagcttctggcccagcccctgtcagcctggtagagacagcacctgaagacagctcaccccgtgggacactggcaagcagtggagatggatttgaagaaggtctgactgtggccacagtagtggagtcagccctttgtgctctgagaaattgtatagccttcatgcccccagcggaacagaacccggcccccctggcccagccagagcctctggtgtgggtcagcaagtgggttgactactccaataagttcggctttgggtatcaactgtccagccgccgtgtggctgtgctcttcaacgatggcacacatatggccctgtcggccaacagaaagtaagtgctgttatggggtgccttgtattcaggccactaatccagcagggccgcaccctcgtgagtgctcctgggctcaggggtctgggtttctcagaggaggggcattggtgcagggctccctctgacctctgcctccccattctaggactgtgcactacaatcccaccagcacaaagcacttctccttctccgtgggtgctgtgccccgggccctgcagcctcagctgggtatcctgcggtacttcgcctcctacatggagcagcacctcatgaaggtgtgagggctggggctgtggtacattgaaacctaacccatcctggccgggtgcggtggctcacgcctgtaatcccagcactttgggaggccgaggcgggtggattatgaggtcaggagatcgagaccatcctggctaacaaggtgaaaccccgtctctactaaaaatacaacaaattagccgggcgtggtggcgggcgcctgtagtcccagctactcgggaggctgaggcaggagaatgggcgaacccaggaggcggagcttgcagtgagcagagatggcgcaccattgcactccagcctgggcaacagagcgagactccatctcaaaaaaaa

SEQ ID NO: 380745 - DNA, 1017 bp, Homo sapiens
aaatattcctgtgcttggcaggacacagtggctcatggctatactcccagcactttgggaggctgaggcaggaggatggcttgaggccaggagttcaagaccagcctgggcaacatagcaagaccctgtctttataaaaagtttaaagattagccagccatgatggctcctgcctgtagtctcagctacttgcaactgcttgaaccaaggaatctgaagctacagtgagttataattgtgccagtgcactctagctcactacacacagtgggctatgattgcatcagactgagaccttgtctttaaatatataggaatgaagtaaatacttgttcctatgcttgacccatagggtgctccccataattaagtggggtgcttaatatgcagaggaaatactttgtattacctttccaaaattccataatacatctgactcaatacattttgtgaaaggtggagctacacagagccttgtcgggccctgcctattggttgggctggacctgttaataggcagtgcagggagcagcatgtgtcacagacctgcctgtccagaggcctcactcccacccttctcctgggaagtgccctccctattggctaaggcagcatggaccctacaaggatgagttaagacactaacatgtcacattctgcccattgttgcccctttaaaagcctcaaggcctaattactttgtccctatgagtcatttatttgttaattcatatgccttcttgcgtctcagctaccctccagcaattaatcataagaggcctgaggaaacatgcaaaaacatatgtaatatacaacaatggtcatggtagcactgggataataaagtattgatacattataaacgtctactaaaaagagcatttaagtaaatttaggttcaccaagataatggaatactatgttgtcatttaaaatgatgttttctaagacaagttaatgcttatgctccaattataatctgaaaaataaaagcatttaatggttcccccatcttct

SEQ ID NO: 380746 - DNA, 1111 bp, Homo sapiens
aaatattcctgtgcttggcaggacacagtggctcatggctatactcccagcactttgggaggctgaggcaggaggatggcttgaggccaggagttcaagaccagcctgggcaacatagcaagaccctgtctttataaaaagtttaaagattagccagccatgatggctcctgcctgtagtctcagctacttgcaactgcttgaaccaaggaatctgaagctacagtgagttataattgtgccagtgcactctagctcactacacacagtgggctatgattgcatcagactgagaccttgtctttaaatatataggaatgaagtaaatacttgttcctatgcttgacccatagggtgctccccataattaagtggggtgcttaatatgcagaggaaatactttgtattacctttccaaaattccataatacatctgactcaatacattttgtgaaaggtggagctacacagagccttgtcgggccctgcctattggttgggctggacctgttaataggcagtgcagggagcagcatgtgtcacagacctgcctgtccagaggcctcactcccacccttctcctgggaagtgccctccctattggctaaggcagcatggaccctacaaggatgagttaagacactaacatgtcacattctgcccattgttgcccctttaaaagcctcaaggcctaattactttgtccctatgagtcatttatttgttaattcatatgccttcttgcgtctcagctaccctccagcaattaatcataagaggcctgaggaaacatgcaaaaacatatgtaatatacaacaatggtcatggtagcactgggataataaagtattgatacattataaacgtctactaaaaagagcatttaagtaaatttaggttcaccaagataatggaatactatgttgtcatttaaaatgatgttttctaagacaagttaatgcttatgctccaattataatctgatcagttaaataaagtacccagcctgccttggtagaaaccagagtcacacactgacttccctttctacttggggcttcctagtttttaagtttaatctagctcacacaagtccttacatacttccttaa

SEQ ID NO: 380747 - DNA, 569 bp, Homo sapiens
catgccagcctgggcaacagagcaagaccctgtctcaagggaggaaaaaataaaaaaataaataaaaatttaaaaaaagaacacttgaagttactcagatcaggactcatgcagagaaaagccaacaggagcaacaccccacattaggggaggaagacacctggggattcactgacttcagttgtgtgaattttaccctatgaccttgcttgctttatgagacagcagaggtggccaaggtcaatcctactgctctgtggtgaactctgcttttctctcgttaccataggtaaagggtcatgctcctatgtaagccttcctgttccccagtcatttgtgcacggggtaggccatcatctcctgcctattcaagggaatgactagtcctgtcttctgtatcctcagtcaccaacttctcagttagtgttggaccaagcctatgttcaaaacatgactgagacagacctcaatccatagagatttatttagccaaggtccaaggacacatctaggaaaaaatacgggatcacaggagcatctgcgccttctactttttccaaagagggttt

SEQ ID NO: 380748 - DNA, 667 bp, Homo sapiens
  misc_feature (659)..(667): n is a, c, g, or t
cgagaaaaagaatttggagacaaagtaaacctactttctgttctggaagctgctaagatgatcaaaccacagactttggcctcagagaaaaaatgattgtgtgaaactgcccagctcagggataaccagggacattcacctgtgttcatgggatgtattgtttccactcgtgtccctaaggagtgagaaacccatttatactctactctcagtatggattattaatgtattttaatattctgtttaggcccactaaggcaaaatagccccaaaacaagactgacaaaaatctgaaaaactaatgaggattattaagctaaaacctgggaaataggaggcttaaaattgactgccaggctgggtgcggtggctcacacctgtaatcccagcactttgggaggccaaggtgagcaagtcacttgaggtcgggagttcgagaccagcctgagcaacatggcgaaaccccgtctctactaaaaatacaaaaatcacccgggtgtggtggcaggcacctgtagtctcagcctcccaagtagttgggattacagatgtttggagccactaagccagtttgcaccagctctcaggatcctcacctgggtattaaatctcgtatcacaaaagaatggccccaagtcaataaattcttcattgtttannnnnnnnn

SEQ ID NO: 380749 - DNA, 445 bp, Homo sapiens
ccgcagtgctgggattacaggcatgagcaccatgcctggcctgaattgtacaccattctgagtattgtgatgaaatctcattccgtctcacccaggacacgaatcattcctttacctagcgtatccatgctatatccattcaccatctgttagtcacttggtagccatctgggttatcaggtcaactgttttggtattgttttgcttttttttttgagacagagtcttgctctgtcacccaggctggaatgcagtgacacaatcatggctcactgcaacctccactctccaggttcaagcaactctcctgcctcagcctcctgagtagctgggactacaggcgtgcaccaccacacccggctaatttttgtatttttagtagagacggggtttcatcatgttggccaggccagtctggaactcttgacctcaagcgatctgcccg

SEQ ID NO: 380750 - DNA, 441 bp, Homo sapiens
tacctttgatctctaaggtcaagaagaaagggttgatgtcaaacacagagaacagcatagaagcaattttttttctccctaatccagagcttactctgttagtatgtggtatccatactattttaaattcaatccctgagagaggaaattagtgttgaaaatgttgagaagagataagacttgactgaatggatatatgacaaaaaactatttcatacttgaaaaggagcttacaaaagaggcaaatctggggccagttcctcaagattcagccactgagcccagggctgggcccagatgctaaagacattctctctttttgtaagtatttgatattctttgtggtatcaagcacaactgaatgtggaaataattttcagctgtcatttcttcttgggtgccttgctgtcaaaatcctgaaagacagctatgtctttactt

SEQ ID NO: 380751 - DNA, 256 bp, Homo sapiens
ttttatttcagaattctgttcgctaacccaacagaaccctggcttcccagacctgcctgtagctgcagggaatcatctctctgaccaacactgactcattaggctgcttaccctaaacatgcttagagttcatataccaaactttgcccctttttgcccatgtactttatgatattgaattttctcctataattacattttaatttaaattcacaattatatgcacattataggtccatgtatatagctctgtgtg

SEQ ID NO: 380752 - DNA, 526 bp, Homo sapiens
ggagacagacaggagagatggaggagagacaaggggagggacagacaggagagatggggagagacaggagaggggggagagagatggagagacaggagagatggggagagacaggagagatggaggagagacaaggggagggacagacagatggagagacatggcggggaggaggagagagagacaaggggagaaacggaaggagagaggtgttgatagggtctggctctgtgtccccacccaaacctcatcttgtagctcccataattcccacgtgttgtgggagggagctggtggaggatggttgaatcctggaggtgcgtctttcctgggctgttctcatgatagtacgtgggtttcacaagatctgatggtctaaaaactggagtttccggacacaagctctccctttgcctgccaccatccatgcaagatgtgacttgctcctctttgctttctgccatgattgtgaggcctccccagctacatggaactgtaactccattaaacctctttcttttgtaaa

SEQ ID NO: 380753 - DNA, 368 bp, Homo sapiens
tctcactgcaatctctgcttcccaggttcaagggattctcctgcctcagcctccagagtagctgggactacaggtgcgtgccaccacgccaggctaattttttgtatttttagtagagacgggatttcaccgtgttagccaggatggtcttgatctcctgacctcgtgatccacccgcctcggcctcccagagcgctaggattacaggcatgagccatggcgcccggcccaaaaggggcctttctaaaggcattttataaaaggtgtttgaaacacaaacctgaaaaaaaaaaaaagactttagtttaacaaaggtaacctaatgcttacccagtgctttttccaccgccatatctgcaaacaggtgt

SEQ ID NO: 380754 - DNA, 403 bp, Homo sapiens
gactccatctcaaaaaaaacaaaaacaaaaacaaaaacaaaacaaaacaaacaacttattagataaccatcaactagatttaggaaatcttagaagaagaaaatgaagaaaaaaaatacagaggttatttgaagataaaaaagggtgaaaacttcccaaattttgatgtaataaaaaaaaaaatttctaaccaataatacttgatttaaatttacttccctttaaaaagaagatgaaaataaagaatttccaaaataaaaggtgaagatgttcatcaccactagcacagttctacaaaaaaaggtacatggtgaccaggcaccatggctcatgcctgtaatcttagttttaggaggtcaaggctgtcagaacactagagactaagagtttaagagcattctga

SEQ ID NO: 380755 - DNA, 261 bp, Homo sapiens
tagtgagcccctttagagccagtctgatgtaagaagatcatgagccaacattcacaggctacacaaaggaaagatttattaggcagccagaaatccagacatctagcaggtttggcattattctgctcaccacagtagaaattacccaagacttcgttaatgcttgcttggttgcaaatgtcttactgctgcttatacagtgctccttgggcagtgattttcatttggaagagctattgacaatacgtatttttttttttc

SEQ ID NO: 380756 - DNA, 850 bp, Homo sapiens
atttagcataatgtcctccaggttcatccaagttgtcacatatagcagaaaacctccttagtttcctcaatatataactagaagattttgagaaaaaagtctgacagaaatcagagttatcatttttgtatgcatatctacacctatggattgattaaaaacaacattgacccagattaaagagatttgcttttagctgcaatgttgctactacctatgtgatctgagtaaaatcacattctttatctgtacatgggttttattatctaaaataaaaacaactgccactaaattttattttaatttgaaattattaccatcacataatttcacatcagatgtcactacaagtgtatctgaccttaattgtatcttctgactaaagctgagaaccaaatgagaattgcataagctccttcagaaggagacaatcatatgtgaggtgaatctcaacatgtccacagattaggtaaagatcaaacaattgagtagctttgatttcacttaaaagaatctcagaactggaacaaaacaagagtgccctctctcaccatcctactcaacatagtactggaaatatgagccagagcaatcagccttttgaagtaaaaggcatccaaataggaaaagaagaaatcaaattaactctttttgtagatgatattattctacacttaagaaaccctaaagattctttcaaagcctcctggacctgatagacaactttagtaaagattcaggatgcaaaatcaatgtacaagatcagtagcctttctatataccaataatattcaacccgagagccaagtcaagaatgcaatcccatttacaatagccacaaaaaaaaaaa

SEQ ID NO: 380757 - DNA, 475 bp, Homo sapiens
ttcaatgtaacagaagattacagaagactaaaaagtcttcttactgatttcttcagaggccccacagtatcaaatatctgcctggctggattagaatatgttctgcacttcactgcactgaatgggaagatttactttcgaagatataagttgctgttgaagaaatctggttgcagaacaccacggattgaattggaagagataggaccctcattgaatctggttctgaggaggacacacctggcatccgatgacctttatacattatctatgaaaatgccaaaagctctcaagccaaagaagaagaaaaatatctccaatgatacttttggtacaacttatggaaggattcatatgtagaacgaagataagcaaactacaaaccaggaaaatgaaggggttgaagaagtgacctgcagaaaggataacagaagaccaggagaaaaagtcaaaaagaatttaaaagaaattatgg

SEQ ID NO: 380758 - DNA, 419 bp, Homo sapiens
ctgacctcaggtaatctgtgctctttggcctcccaaagtgctggaattacaggcatgagccaccgggcccggcctactatttcattaggaatagaactgtcatctttcaaatgcctacttgctgttttttttcttttccattgatcacatcttcttgtccattcctcctccttttacatctttctcttgctgatttggagaaatactttctatactaaacatactttttccagttagttatttacctttaatcatatatagcatgtttttctctagggaatctttaaaaattttagttttaaaatttattccatctttttctctttttctttgtggcaactagttttagaatcatgctacagaaaggcttcactacaatcagagtagaatacgtgtttaaatggttacttccagtattc

SEQ ID NO: 380759 - DNA, 271 bp, Homo sapiens
aaacttgttaaagtttgtagaagctgagttgttgatttctgtggtggataaaagccagtgctgtatctggaaactgttttcctgtttttcttagataccccttgaatcggatctgtttaatggaagaggatttttctgttaagctggttataatgccggttaaactttgtgtttaggatgttaaagtcctggaatgaatataattacctgcctatataaaaaaagctgaagtcatttgacgaaaagttaacaagtgcaggcatgtgagcta

SEQ ID NO: 380760 - DNA, 961 bp, Homo sapiens
aaatacatttcatttcatttgtacaatgagaaaaaagatgaaaaggcaaggttgttattgcagttgacattgtcagccctgccttttggctttatgtaatttaaaatagaaagggggaaggaggacaagacagaagctcaactttagaaaccatggacatcacctccctctttgagaggagctgcttgtgaaccaggctccagtcttcctgtggcctctcacagtaaccctgcccctttcttacctcacaggggcaagagggactctaaagagggcgtaagcaatagaggcacctgcagccctccttcctcagcaggaaatcaatgtggagccccagagggacattttatctcagagagagcatgctggccacaggacccagtgcagccctgcttcctgcaccgtgggtctttcctgatagctgcaggcttgagattgcagcctcaggataggacacgttcagatgccttccagactacacacactatgcttagattcgagagtctttcctgaccttaaaatttgtcccttgcttactttcacactgcagaagatttatatatatattcatcattatttttgcagcagtacaagtggaaacttcaaaaaaatcattccctttcatgtcctggtctttttaagtcttgatatgtaaccattttcataaatatccaaacagagattgtcattccccttaaaaacagaaacaaaacacaaaactagtgcttgtgaaaacacacagcgcaaagacaattatcctattgcattaaaaaaaaaatcagtctgcctagagacatttcattggctgcattgtcttaattccctaacgaaactgcatcaaaatgtcagttgtaatttagcctctgatcagctgttaaatattatttaaatatttacaggtcctgtggggtatctcccattacccatgtcgccctcaaattacataagcgatcataaaaaa

SEQ ID NO: 380761 - DNA, 267 bp, Homo sapiens
gcggctggagtcccagtcagcctccgctttcatcccagagcagtcccgggggccttaaaggaatgtaggctgggtgaagttggcccagtgacacctgcgttcagaaacgttctttccgctcccaacgccccctctccaccgccacccgacccccgaatagttttccccgagtgttgtggatagaactgttgatctcttggaaaagttattgtatcctgccatccttccctctggagactccacttaatatatataagtactttcttt

SEQ ID NO: 380762 - DNA, 484 bp, Homo sapiens
aaaaatatggattctactttttaaacatggtctcagtagtatcattacagccccatcaaaatgaaaaacaataatttcctgacaccatcaaatagctcatcaattttactatatttcctcaatcattcaatacgtgttttttatttattttattttattattattttttgagacagagtctctctctgttgcccaggctggagcacagtggcgcgatctcagcctcattgcaacctctgcctcctgggttcaagtgattctcctgtcttagcctcccgagtagctgggattgcgggcacggccaccatgcctggctaattttttgtattaaaggaggctgagacaggggtttctagggttggctaggttggtcttgaactcctgacctcaggtgatccgcccgcctcggccttccaaagtgctggggattacagaccgatttggggatgttgccccgggatgagcctgctattcttgttagtga

SEQ ID NO: 380763 - DNA, 441 bp, Homo sapiens
tggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaa

SEQ ID NO: 380764 - DNA, 804 bp, Homo sapiens
gatcgtcccactttggcctcccaaagtgctaggattacgggcgtgagccacagcgcctggcctccttttctttatagtaatttgaatgtggtgattttaatcctccatggttttcttatccttcctcaacaaacagcaaagaggctgctggaaagccacatgacatttgctgtgatttgcacggctgatgggaaaacactacttggttctgaaggacagggttgtcattggatacctttgccctctgacccgagtgagaatctcacctggacaaagacccgagttgtgaaatcacacagagaaagtgtgattccgaacctgctgctgtcctgtgcttcctgaggacaagtgagtgactgactccgtgtgccaggaactgcaggaggttaaaaactttcagaactaccatgcaaataagaaatttcaaaggacttttctctaacacacatttcatagtgaacgtctcagctggattaacataattaacgctgtgttctttctggctcctgaaagaaattgtgattaggaacactttcagggctgatgagtctaaggtatcaactttgtcccttctgcccacttgaagttcaaatggaaatgtttgctttcatagctccagtcatgatgttactgtatttagtagctattaagtttccaattccatagactcctgggagaagttccagttcgcactaaggcttctgttgcatttagcaccactgcctatggtgtgtggagctttcctgaacaagtaatagcagcaaggttcttagcttagtaataattttaagctattctttgatt

SEQ ID NO: 380765 - DNA, 378 bp, Homo sapiens
ggtatgacatgtgtctctaacacccaattgaacttgaagcagtgaggctgtgtttgacaacacaagtagggaggagagttcgtgagcccatgcttgggaagtgtgctatagaggaacaaggagtggaggaggaggaattcagctatctctggacattgaaatagcaaactatccttaggacctttcagagagcagtgggccacataagggaaaccatattcgtaggaacgagctttatctcctcttcaagaagattgtaatgacttcatatagtgtgaagagtagatgataaagccagactgaggggggagagggggaagtctaaacctgaagtcagtcaccattaggtcttttttcttaaggaagattacatttggg

SEQ ID NO: 380766 - DNA, 368 bp, Homo sapiens
agaaatatggctaagtgcagaataaaaaaggctataaaacatggaccttcttaaatgaagttaattcagacgtaacaaaaattcatatattatgttccttgaaacttaaaaaaatgcgactttaaatttaacactctcaattctaatggggatatgagttaattttcaagtatattttagagctcaagtttagttaaccaataacttgctgaattatgcaaaaagctttggctttcaaaatcttattgcttttcccctgtcaagatttaataatttttagtaagggtttgaactttttaaccagatatgccaaatctcccaaatgcatgtataagatgttattatgttaatagcaatgtataatacaa

SEQ ID NO: 380767 - DNA, 408 bp, Homo sapiens
cgaggtcaggagatcaagaccatcctggctaacatggtgaaaccccatctctactgaaaatacaaaaacaaaattagctgggtgtggtagcagacgcctgtagtgccagctactcgggaggctgaggcgggagaatggcgtgaaccgagatcgcgtccctgcactccagcctgggcaacagagcaagactccgtctcaaaaaacaaaaaacaaaaaacacacacaaaaaacaaacaaaaaaaacccacccctgtcatcaagcatgtgatttgagaaaatttcacttcacttctaagaacctgtgtcagtttttcagtcaaatgaagagttgaatcataattttgaagattcttgtaggtctaatagattaaataattatgttaatgtctgttttacataggaataaga

SEQ ID NO: 380768 - DNA, 183 bp, Homo sapiens
atatcacagaagcagtgttcactgttgtataaaaatttccttattcatgataggtgtatctgtatatgttaacactttttaaaatgcttcttttgcagctaggatgtttgaacataagctatctactaatgtatcattgtatatgatcttgtttgatttataagcacagttcttcaaattgtg

SEQ ID NO: 380769 - DNA, 332 bp, Homo sapiens
tcaattatccatctacctatctattgattatctgtctacctatctatatctatcatctcatgttttccttattcattcatccactgacagacacttaggttgtttccatatcttggctatcatgagtaatgctccaatgaacatgggaacatatgtagatatctcgctgaggtgttgatttcaattcctttgtggatatacccagaaggagaattgctggatcttatggtagttctatttttaattttctcagaaagtttcataccattttccataaaggctgtacgaatttacatttccaccaacagtgtagagagagtgtagagagttat

SEQ ID NO: 380770 - DNA, 249 bp, Homo sapiens
tgggagaaaataactcacaagtcgcatatctgataaaagacttctgatcagcaaatataaggaattctcaaaactcaattaaaaaaaggtttttttaacgtgcaaaagattttagcagactcttcaccaaaaaaagatatacagatggcagataagctcacaaaagcatgctgaatatcatttgtcatccaagaaaatgaaaactcaattacatatcccactatacacctatccgaatggttaaaagaa

SEQ ID NO: 380771 - DNA, 2131 bp, Homo sapiens
ccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaatactcaa

SEQ ID NO: 380772 - DNA, 472 bp, Homo sapiens
  misc_feature (297)..(297): n is a, c, g, or t
aaaagccacccatatctggctttcctctttggctgaaaaccgtcagcatttccgtccttgcctttggggtcctacttcattgcctggacaggatggagttcgcccagtcgagagcttcagacaagcagactctgttgccccaatgacccagctcctaccagcccctcaaggatcgagaagatgacccagtacagccaccttcaaggaaacccagttgaggaggaattgaactcaggactcagagtagtcccaggtgttctcctcctattcagttcccagaatcaaagcagcccgggngattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaatactcaa

SEQ ID NO: 380773 - DNA, 347 bp, Homo sapiens
agaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggtgaggcctgaaccggaaccctgccccacctgtgctgtcctgtgactcttgcatctttgtcttgcctaagccatgtctccctgactcacacatctctgtatcccagatgggaggtgggtcagaggaccagaaagtctcaattctagttcatgcttttccaagagttccctggtcactt

SEQ ID NO: 380774 - DNA, 3299 bp, Homo sapiens
aatatttcttctgacagtggacagctgacatatcaccactttccttctactgtgagtgtctctggatgggcagaaaggaatggccagcccctggttatggtcatctaaggtcacctctgaaatgctgtgagcccctcttccttcctctcctctgctatttcccatctctgctgttggcaggagaatagaaccctgggctgccagagatgcaagtgtgtgacgatatgggtgctggtgcatatttagtatgtgcctgtgtccagccatgtgcatgtgtgggtgtgtgagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaatactcaa

SEQ ID NO: 380775 - DNA, 413 bp, Homo sapiens
ctaacgacctcactttaacttacttaccttgttggagaccccgtgtccaattgcagtcatatgatgaggtactggggtcaggacttcaaataggaattttcagggacatagttcatccagaacaggcatatcctgcccattgcagcttcacagattgcagtaagccagaagtcacacctgtaattgcctaaggcttcgcccactgctctgttaggggaagaggctatagaagacaaaggaatgacaccctgtgtgcatgtgtatgtgtgcactatatgtgtgcattgtgtacatgcgtgtgcctgtgcggtgtgtgtgcgcacatacgggaagttaggatggggagccgggttggagacgttgccgaccctcctgttctcatcagaaagcctggactgatgaggaaggattct

SEQ ID NO: 380776 - DNA, 946 bp, Homo sapiens
  misc_feature (1)..(2): n is a, c, g, or t
nnacagcccaccagtgaccatgaaggctgtgctgcttgccctgttgatggcaggcttggccctgcagccaggcactgccctgctgtgctactcctgcaaagcccaggtgagcaacgaggactgcctgcaggcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtctgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagcacagcgtaggcccttaataaacacctgttggataagccaaaaaaaaaaaa

SEQ ID NO: 380777 - DNA, 848 bp, Homo sapiens
gcctcaccctgcgctgaaggcgttggggctcctgcagttctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgtgagtggggggacgacagccgccaggcctaggtctctgccactgaactattaatctttctggccatctgtccgcatctatgtgctgttttccttccacctgtccccgacccgtcccgcacctgcacccccaacaatcacccagcatctgtccctccagccatcctcctccatctgccactcctccactcgtctgtccctccccatcctccatcttccactcctccacccgtctgtccctccccatccctgagctcgcttactcactcaccccatttctgacgctcagcgggtggtccatctgcctcggacatctggatagggctgagaccagggccgagaccaggccctcgcactgcttgcaatcctgaggccagcccagggggactctagagcattaggcagggtggggacaggaggaggcctggggcaggtcagcaggtgagcacacagggcagccccatccccggatcccgctgctcc

SEQ ID NO: 380778 - DNA, 949 bp, Homo sapiens
  misc_feature (1)..(2): n is a, c, g, or t
nnacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtctgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagcacagcgtaggcccttaataaacacctgttggataagccaaaaaaaaaaaa

SEQ ID NO: 380779 - DNA, 1182 bp, Homo sapiens
gcctcaccctgcgctgaaggcgttggggctcctgcagttctggggcagccacaggcgcccagggtttcgtgccgatcagcccaggacggtcttcccggtgcagtttctgatgcggggagggcagtgctgccttccggtcaccaggaccagtgctcagcccgcctgcttgacccccttacttagctggggtccaatccatacccaatttagatgattcagacgatgggatttgaaacttttgaactgggtgcgacttaagcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtctgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagcacagcgtaggcccttaataaacacctgttggataagccaaaaaaaaaaaa

SEQ ID NO: 380780 - DNA, 995 bp, Homo sapiens
  misc_feature (1)..(2): n is a, c, g, or t
nnacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtctgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagcacagcgtaggcccttaataaacacctgttggataagccaaaaaaaaaaaa

SEQ ID NO: 380781 - DNA, 288 bp, Homo sapiens
gcaacatttcggaggcactgagcagggggccgtgaagatggggaggagacattgagggtgacaagagggcgccgaggacttcctcaggccaccgccatggaggcccacctgcctgggagcccccattcctggggagtgctatggggcagcctctgaggcccctcccactccaccccacaggcactgccctgctgtgctactcctgcaaagcccaggtgagcaacgaggactgcctgcaggtggagaactgcacccagctgggggagcagtgctggaccgcgcgcatcc

SEQ ID NO: 380782 - DNA, 370 bp, Homo sapiens
  misc_feature (294)..(294): n is a, c, g, or t
aaaagcatgatattaaagacactgtgctccatgactcagaagttgaaagagctactttgaatctgcaaatgatacctccatggatgtcgcctaagttcatgaaagatggaagcatagtgacagtaacaataatttaagaaggtttgaaaggaaaatcttggggtccccaaatcactaagctcaagggaaaagtcaagctgggaacttctcagagcaaacttgcctcccgttttattcaaagttactcctggccaggtgcggtggctcacgcctgtaatcccagcactttgggancccagggcaggcagaacacgaggtaaagagatcaagaccatcctggcctatatggtgaagccccatctctactaaa

SEQ ID NO: 380783 - DNA, 328 bp, Homo sapiens
agagttcgtctgtttaaggtgtacctaccattcagcggtttttaagggggcattagattttaaaggaggaaaagtttatgtttttgttagcatatgtcattaaagaaaatgattataatttatctatggtctttattaattattatggaatggctgtatatagataagagacagaagaaaggaaagaaaattacgcataatcatacatcatactacccctaaaacaataataggcaatacttttgtttgtttctttttttatctcaatgcattggggtgtgtctttttctttcattttttttttttagacagaacctcactcacctag

SEQ ID NO: 380784 - DNA, 2041 bp, Homo sapiens
ttttagacagagtctcactttgtcgtccaggctggagtgcagtggcgcgatctcggctcactgcaacctctgcctcctgggttcacgccggttgtcctgcctcagcctcacaagtagctgggactgcaggcgcctgccactacgcccggctaatgttttgtatttttagtagagatggggtttcaccgtgttagccaggatggtctcaatctcctgacctcgtaatctgcccgcctcaacctcctaaagtggtgggattacaggtgtgagccaccgcgcctggcctaaataaaaagtcttgaaatggaagatattcacctaaccctcaacaaaccatgatgtaatgaagcacgaatcacaccattttgtctctttcctaattcaaataggtccctggcattagttcatgccgagactagaaaactgaaccctagtactgttttttaaaacagttttaacagaaaattaaactgtatgtttgaaatcataagtaaaagtttgttgcttgcataagagtagcctcttgattctcatagtggtaattttgtgtcatatcatttagatgttgaaccatttcatttgtgcatgtgtatatgtgcccaaattcatcctctttgtttagaatctgcttacaaataaaactaatagaatctgaatacatttatcatatattcttccagggtttttcttaactgactatagagagtggctgtaagttctggggcaaagcttgattgtattttcagtgatgtatagttacattgtttcatgttaaaatcatcgtgcatggaaagtgaaatgtgcgtatgattttaaattattgtaatatgtactatacccttcccctaaacttctttcattgatgatacacagaattcctctatttttgcttgaaaatagtcctttagattggagtagccttttcttagatccctctatggttccatgagatgaggtgatacctgcaaagcacttttaaagatatttttttaggctaatgtccaagatacagcattgaggaggcagctatgtctaatgagggctctcttgtttgctagagatgagagaaatgtatactaatcattttaatttgtacttaaaatacattttactaatcatattgattttaaatatgacaaattcttctagtagatactaatctttcttgtttatcatattgtcctagagaagcctaggtaaaaatgggttccacctagtctgtttgtataacaccttcccccgtcccctctccatccctgccaattgggctctatgcatattgacaagcaaataagaaaaccttaggtttcttgtatttgaatttccaaaacaataaaaggttttgactcaagatttgcattcaagaagaggcagaaattttgtcttatctttttatcattttgtgaacttgtgtttctctgtatgcttagaaaattttacacacaaggaatgtttgaaaaagtgagaattttagagtgcttgggtggtttttatttggtcagtgctgatgtgttaggtgtttagggaaataatgcttcaggacctttttgacaacacagcttcatgaatgactgggggatatttatgtttgtgctgagaaaagggagggagtgggcaggttggagtggggacctttccattgaaagcagtgcagtcagctgtttcgtagatgcattttttctttatgcttgtaacattgttcttgtgtccataattgactgaaatgtcaagctccaggaatgcaaggcatttatcaggtgaccagaagtagaaccttgttgattatgaaatggaagaataatgtcaaggtagtgggggtaaaatgacaaataagattttactggtgaatttccatgcttagtatgtacattaacctctttttaagttgcatgttaatctggtataacgtattgtgtctggtttatgctttgagtaaaaaggaaaaaaaaagacttgagttacaattgttactctattatgtactattacatataccttttcttttagaaagggttaattataattactattcacacctctg

SEQ ID NO: 380785 - DNA, 508 bp, Homo sapiens
ctagcaggctgctggctgcccacatctgcacttcaggagacagggctgggctgcagatggagggagagctgagatctcgtagggagaagtgaagaccagaatttaggtgaggtgcccagactgagtgtgtggggtggagggaaaggggtctgacaatctaacgactcaattaaggcattagactggatgccttctaggcacctttccagacccaaaaactctgagcccttgaaatgttgggaatgaggctgcccaaagtagagattttaacaatctggattccaatcagcttactgccaccagccagctttggtgtgactttaggcatgtcacaggctttctaagaccaaatgaatgtccagcccttgtgttgccctattttagagttctgtgtaggacttccatatatacaaggctccaacttacctttcaggattaaagggctgggggtgggggaccaagaaagagacattcaggtaagacaacttttaagcaacagataccttcc

SEQ ID NO: 380786 - DNA, 1150 bp, Homo sapiens
tgggtttttgccatgttggccaggcaggtcttgaactcttgacctcaggtgatccgcctgcctcagtgtcccaaagtgttgggattacaggcacgagccaccgcgctcagccaatttttcctcaactctctctttcctggacgggctgcgttggggggaggcgcagggaaagaacacctctttgcttagacattggtgtcgacagtggggatactaagttcatctcctgatcctgctaggcctggaagcaggaaagaaatgtcctggttagagataaaattgttctatccttttagaaaagcctgttaaggaatatgatgcaaagccaccttcgacgaaatctgaaatgataccccacagccttgtccaccccaattattcagtgacagggctccagttgcttaagccatagagaaggcccctttgcagtgggagtcactgaagacagaaagggaagcccaggatgaacccagtcctaagggctgctgggggccaccaaataagactgttttagccctggacacagagggagacacagtcatcccagatccttacaaagaatacattgccaaggaccccgaaggaaatctgcttgtcttaagagaggaagacccacgaccagctctctgggactacctgtcaactcagcaggtgcagccagggagcagccatgcttcttctgccctcccagtaggctgggctatcagttcctgggaggggtcctgtccccatgtaaggggatatgtacattgctgagtacgctgatatctttttcatgggtatgattttttaacaagaaagctaaatggttctcgtgtaacataactgatatagtttggctgtgtccccacccaaatcttatcttgaactgcagctcccataatccccaggtgttgtgggagggacccagtgggaggtaattgaatcatgggggtggttaccgccatgctgttctcgtgatagcgagtgagttctcacgagatctgatggttttataaggggctttccccctccttcgctctgcacttctccttgctgccatgcgaagaaggatgtgtttgcttccccttctgccatgattgtaagtttcctgaggcctccccagccatgttaaactttgagttaattaaacctctttcctttataaatt

SEQ ID NO: 380787 - DNA, 1585 bp, Homo sapiens
gatggggtccgaccccactgagctccccagaaggaaacccagagccttgcatcagatgtcagctgagggcagtgcagaccccagggccaagagtggctctgctcccactcctgctgctccccagcatgctcggctctttatggcaggatgagctagaaaagacatatgaaagcacaatcccacacctctgtagagagaacactggcagtggtgataccagttaggaggccttgggctccaagtaatagcagctccctcccccagggcacaagtagtgaaggatctcctcagtctctgtaagtggaagttcagagctgcatgggctccaggcacagaacagtcaggtctccggttccattgctcttgtgattctcgtggtcccacactcctccatggatgttatcaacagactggggtccctcatggttgcagatggtggccaacagcagctggggcactgtctgccttgtcacagccagcaggggaaaagtaggcctattgttgtcttataagcaagagaacatgttcccagtagcctccagtgacacactccttgaggctttattgaccagaatctcttacatgtctgtttatgaatcagtcactggcaaggaggaggaaattgtttttcaaactttttaaaccatgacctgcagtcaaaaacacctgttacctgcaacatcatggtccagttcccacacacgcatgcgtacactcatgcatatacatgtaattgaaagcaaagtttcacaacatgaatggggtcagcttccagggcacatagcttcatgggaaggggtggcagggccactgtcatgtgcagctgcagggcaccttccacatgggctgtgactgctggagttgtacactggggtcctgacagaaccagggtgggggagggcagagtcccaggagacagccagcagggccccccccagtgttggctctggttgtggtccctccctagcagacacttgctgtggtttctggccagatgctgtcatctgctgggtgatgctgagagctcacccttgctgagtgctcgctgggagccgggcactacttggagctctccacagatgcaaactcactcacttggtcctcaccatggttcacgcacacaacagaagtggccccattttacctataagggaactgaggcacagggaagtagaggaatgtgctcaagagtcccatggctagtggcatttccgtgctcccgccaccaggctctactgtcaacatcatccctatctgcaacccaagaggaatcagaaaaatagagccgttagcagtccactttaagtcaggcacagtggctcacacctgtaatcccagcattttgggaggccaaagtgggaggattgcttgagcccatgagttcaagaccagcctggacaacatagcaaaaccccatctctacaaaaaataaatattagtgggcatggtgacacatgcctgtagtcccagctactcaggaggctgaggcaggaggatcactcgagcccaggaggtcgaggcgacagtgagctataactatgccactgcacatcagcctggacaacagagcaagaccctatctctt

SEQ ID NO: 380788 - DNA, 1531 bp, Homo sapiens
gatggggtccgaccccactgagctccccagaaggaaacccagagccttgcatcagatgtcagctgagggcagtgcagaccccagggccaagagtggctctgctcccactcctgctgctccccagcatgctcggctctttatggcaggatgagctagaaaagacatatgaaagcacaatcccacacctctgtagagagaacactggcagtggtgataccagttaggaggccttgggctccaagtaatagcagctccctcccccagggcacaagtagtgaaggatctcctcagtctctgtaagtggaagttcagagctgcatgggctccaggcacagaacagtcaggtctccggttccattgctcttgtgattctcgtggtcccacactcctccatggatgttatcaacagactggggtccctcatggttgcagatggtggccaacagcagctggggcactgtctgccttgtcacagccagcaggggaaaagtaggcctattgttgtcttataagcaagagaacatgttcccagtagcctccagtgacacactccttgaggctttattgaccagaatctcttacatgtctgtttatgaatcagtcactggcaaggaggaggaaattgtttttcaaactttttaaaccatgacctgcagtcaactcatgcatatacatgtaattgaaagcaaagtttcacaacatgaatggggtcagcttccagggcacatagcttcatgggaaggggtggcagggccactgtcatgtgcagctgcagggcaccttccacatgggctgtgactgctggagttgtacactggggtcctgacagaaccagggtgggggagggcagagtcccaggagacagccagcagggccccccccagtgttggctctggttgtggtccctccctagcagacacttgctgtggtttctggccagatgctgtcatctgctgggtgatgctgagagctcacccttgctgagtgctcgctgggagccgggcactacttggagctctccacagatgcaaactcactcacttggtcctcaccatggttcacgcacacaacagaagtggccccattttacctataagggaactgaggcacagggaagtagaggaatgtgctcaagagtcccatggctagtggcatttccgtgctcccgccaccaggctctactgtcaacatcatccctatctgcaacccaagaggaatcagaaaaatagagccgttagcagtccactttaagtcaggcacagtggctcacacctgtaatcccagcattttgggaggccaaagtgggaggattgcttgagcccatgagttcaagaccagcctggacaacatagcaaaaccccatctctacaaaaaataaatattagtgggcatggtgacacatgcctgtagtcccagctactcaggaggctgaggcaggaggatcactcgagcccaggaggtcgaggcgacagtgagctataactatgccactgcacatcagcctggacaacagagcaagaccctatctctt

SEQ ID NO: 380789 - DNA, 4588 bp, Homo sapiens
  misc_feature (1806)..(1806): n is a, c, g, or t
gaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccatgggagcccaggtcatggggcagccagggcctctgcagtgtgaggcgccggtctgcgggcgggcaggcgggaggcttagggtgggtcgcggtcgcggcccccgccgcaggccctggcggcggcatcgtgaacatagacgtggagttccacatccggcacaactacccctggaacaatttgccggccaatgtgaggcagtcattaagtggagatagctcatcatggaggtcttcatctttgtcttcacatcaagtaggctgaggaggaggaaatacaggaagtattggtcctgctgttcagagtggcagaggagaaagaaaatcccagccgtgttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttaccgtctattggatattatggtgaagggcttcagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgagcatgcgcttactctgagaaacacaacactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaatacacactgcttgtttccatggctnccctcaccatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttacgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaagaagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtatatagaaaaattgctacacatggcctttgcagaaaagagagccttcaaaaacctcttacattccagtagaaaactctctctgcaagtccttaactttgttcactcattccaggaaggtgcttcaacattggatattcacacagagcccagtttttcaagtttgctttcacagtcatcgtttgctgacatgggtgttccacttcctgcaaaaaatttaacatttaaagatagtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtatttttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcaccctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttacctttcttgggaagtttgtgtagtgttaacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtattttttttaatcagggctctttaatctcattttaatttcctttgtttgaatgaactgtagttattttctgtattcctatattaaccatctaaaccaactgtaatgacacgtacactaataaagaattgaacatttgtatttgt

SEQ ID NO: 380790 - DNA, 1456 bp, Homo sapiens
cttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggctctgattgtactttctccacaagcttcagcatggcagtatctctcaccacttgttttggtccaagggcagaaatgagcatcctggaaaccaatcagtacttccgctctgaactggaaaagtgcaaacagaacttccaagacctcacagagaaattcctgacatccaaagctactgcctactccctggccaatcacctgcagaaatatagatacatgatcccttaattcaggctcaggctgaagaactgacccacttacgacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacagaatcaaccccaatgctcactaacaaactgagaagaaaaaaaaagaattacccccaacaacatctgaggaagcacaacagggacagacttgaaggcacctgggcagtcctctggttttggagtagagaaaatcacaatggtaagaaaaatgaagacaggcaaaagccactggctcccaggatgcacctctaacctctacaggcaaatcatagattccattgtccagctgtataatgaaaacagagttctcagagaagaataccggagactcccccgacttgcctgaatcaaatttccagaggtaagtggtgaaaggccacaatatgaagtcactctcagatgggtctcttctcttgccacactccactgtagaaataaaagaggacggggaggccagagctgctcaaaaccttataacccacaattctcatagttactctcaacttagagagggctgctttctagacacaccccctccaggcccccagactgccaggctccaggaataagtagctctaagaaatacagtatttcagtgtgagccacaccccactattgcaaattggagaggagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcgccactgcattctagcctaagtgacagagcatgactccatctcaaa

SEQ ID NO: 380791 - DNA, 5731 bp, Homo sapiens
  misc_feature (2949)..(2949): n is a, c, g, or t
cttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagtccttggaaaaccagagatattagagcggtgaatcgcgctggtcacgttggacacctgcgcgttaggagattctggagccagagggagagaccccagaaactccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggctctgattgtactttctccacaagcttcagcatggcagtatctctcaccacttgttttggtccaagggcagaaatgagcatcctggaaaccaatcagtacttccgctctgaactggaaaagtgcaaacagaacttccaagacctcacagagaaattcctgacatccaaagctactgcctactccctggccaatcacctgcagaaatatagatacatgatcccttaattcaggctcaggctgaagaactgacccacttacgacagaagatacaggaagggagaggtgtctgctaccttttcacccagcatgtgaagaacacagtcaagtcttttgagggccttctcaggaacactgacattgcctactaccagagacagagattctgtgagcaaatggtacaaggaagccagctgacagagatccttgtcagaaaacttgccacagagtcttgctctcttacccaagctggagtgcagtgacatgatcttggctgactgcaatctgtgcctcctgggctcaagcaatcttcccacctcagcctcccaagtagctgggactacagaatcaaccccaatgctcactaacaaactgagaagaaaaaaaaagaattacccccaacaacatctgaggaagcacaacagggacagacttgaaggcacctgggcagtcctctggttttggagtagagaaaatcacaatggtaagaaaaatgaagacaggcaaaagccactggctcccaggatgcacctctaacctctacaggcaaatcatagattccattgtccagctgtataatgaaaacagagttctcagagaagaataccggagactcccccgacttgcctgaatcaaatttccagaggctgaggaggaggaaatacaggaagtattggtcctgctgttcagagtggcagaggagaaagaaaatcccagccgtgttggaaattcacagagagaatatgaaaatcaggttgtcctgtacagtatctgcaatcagttacgatacagaaataacttaaacatgtcaagaaagatgaacgcggatactatgaggaactgctaaactacagccgagatcatctcatgctgtacccttaccgtctattggatattatggtgaagggcttcagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaatgatgggaaatctttcaccagttcagagcactggtgaaagagaagcacagagatattttgagcatgcgcttactctgagaaacacaacactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaatacacactgcttgtttccatggctnccctcaccatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttacgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaagaagactcgtgtcaatatgggtgttcataaagcattgcagatactaaggaacagagtggacttacaacatctctgcggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtatatagaaaaattgctacacatggcctttgcagaaaagagagccttcaaaaacctcttacattccagtagaaaactctctctgcaagtccttaactttgttcactcattccaggaaggtgcttcaacattggatattcacacagagcccagtttttcaagtttgctttcacagtcatcgtttgctgacatgggtgttccacttcctgcaaaaaatttaacatttaaagatagtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgcggagcaattcttgctttactaatattaaaagtttggggaacatattcatgttttctgaagttttgctccttattgcacatcttattgcaacaaagtgctttttagcatccagcactgtatttttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcagttggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcaccctgatttatttttttgtttcttacctttgatgttttcaaaccaaggattgtgattttaggttagaattacatattagaagcattaagactatgtctttggatcagaatgctttagtgattaacctactttgaagacatactcttaagcaatctggatcttaaatttatgtgaatacatttttagaaaatgataaagaaaaatggaattacttcaaagtgtttcttgagtcattgattcttttagcatctcaaatgttaattagaataattggaatcactttttagacttttcaagttacctttcttgggaagtttgtgtagtgttaacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtattttttttaatcagggctctttaatctcattttaatttcctttgtttgaatgaactgtagttattttctgtattcctatattaaccatctaaaccaactgtaatgacacgtacactaataaagaattgaacatttgtatttgt

SEQ ID NO: 380792 - DNA, 2031 bp, Homo sapiens
cgttcattgaatatttttactccagattcagatacagatcaagagagaatcatatgaacctataaaggtccgtcctcatgacaaatggagacagccaaactaattttcttggtgaccttatctaaattagttagaaaataacacttcagatttatgactagttacaattaagccctttgatatcttctaattaaacctgtaaagatttatttctgcattattcctttggtactctcttaaaaatgataaaaatgtaaatgaatattaccctcaaaaggagatgtttctatttatcctaaattagactcatacccttcctttcaaatgactgcattttacactcagatttacactgctccaatacaaattctacatcgatcttaaataacttatttataaagtttgcacaaatgttatacataatctattggaatataaataaagcagagccccctatatttcagccttttttgtgtgtccttctttttagcactttgtcccatttcacataactctatattcaaatgttgttttagaaagtattaggaggctaatataatagtcaacatcattcccagtttactctagctagtagagcagggctttcttgcctggatagcttttcttcaaacctttatctgagaaaagatgtgttcttcataatgactctcctaataggattctctttgctctgaaatgttcaatttgtattctccgatcgttttgcagatgccaaaattatgcagctcagaccagcgctgttttccatttattgttcctctgtttcttttctctccaggtgagtacagctacctggggactactcttcgccaggtgtccatagaacccatgccctccctcctggatgtcagacagctcatcacattgtacggaatctggccattaggtaaagactcggcgtgcgcggatgtgccttttccaaagcagcttgcaccgcttgctggtttggacagtgtgttcctgtttgtcatcaaaagtacagtgctccttaacttttcctactgagaattctgagtgggcacagtttcattttgatagtgcacccaccagcacacaaagtactaccagggagagcacttctgcaccctctctgcgtgcctgcttagcagtgctgggctgaaggacatacaggcaatgagctggggagataataggcaaagcaagtacctgcaattacgattaatcaaattagagaacgggctagggctaccacttgccttttacccacaggctcctattactaggtcctaaacagaggcagcctttcaggagtcagtgcaagtgtgtttcatggatctaaaggatcacctttaaggccctgccagttttcaccgacgtctactctcactgctaaatgaggttcaattgtgacttttttcagacagacacactagagctctgtggtgtgcaggcgatgcaggaaagatgggctctccacagcacagatatctgcggctcacgttcgcttttttctttttttttttctttatggctttgatatgtgtatgacctgaatcaccaggggcagggatggcaactccagccaggagtttcagttctgacaacaactctcaaatagaaatcaccttctgggtttttaatttgctttaaaatgagatgggagtagttcaaacccttattgttccactttgacttcagaacttaagacttcagaacttgcctattggcaagaaatagttaattcctcttctaaattgatgtcagaagtagtaaatggaatttggggttaatatacatttatatatatataatatatatgttttatataatatataatagcacataatttatattatatataacaaatatatcatatttgaggggcaacataatttgtggtcaacagaataaatgtataagtgtcaatggaaataaaatagaggagacctcacacttccatgaagcatcatggaaggcagtaagacagaaagcaccagtgagccaggcatagtggctcacgcatgtaatcccagcactttgggaagccag

SEQ ID NO: 380793 - DNA, 735 bp, Homo sapiens
gtgccacctaggaacctgggtctttcctaactcctaattgcctctctcctacttcttagcatcttcatgcagagcatagtgatggttctgtgtagttaaaaggaaaagagaaaaagatggaggaggggagaaagagagaaggagaagaattgcgggatttgagaaagctggctgtggcttgccccaattattttacggatgacaaagcagactcagaaaagtcaggtaacttggctaaaaacctgcctagttactggcagattgagaactacaatctgggtgagtaaagactttttgaaacacgagcattgtgtaaaactagaattgtttctcaagagaaagttcagaattgttctctctgaggacttctaaggacatcaaaggaaaccacctgaaggttcacaatagatatcttctgaggaccatggctaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaaggtcagtttaggagaacgtgca

SEQ ID NO: 380794 - DNA, 2298 bp, Homo sapiens
gcggccgcctactactactactactgctcgaattcaagcttctaacgatgtacggggacatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaacgtgccttggcgataacaggaggcagcacagaaaaggcaaaggacaaagggaaaaggaaata

SEQ ID NO: 380795 - DNA, 1738 bp, Homo sapiens
tttccgaaacttctattgtatttcagaactggtatgccaaaactcctctgggtaaaaaacgtgccttggcgataacaggaggcagcacagaaaaggcaaaggacaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaacgtgccttggcgataacaggaggcagcacagaaaaggcaaaggacaaagggaaaaggaaata

SEQ ID NO: 380796 - DNA, 2259 bp, Homo sapiens
aagtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggtacagctacgtttatggtgtagtaacagcaaatcatttacttcaaccattgtgcttctttacaaatttccctactaaatgacctaccccataatttaagggatttttaaacttcacaaacaaacacaagacatgcaaagtgacttaaaagtagtatgttttgtattctcctaggttgatgagttgatgagacaggaacttaaaaacttaaagctagctgtggacagagaaagggagcgcccagtgaaagcaggaaagaaaaaggacaaggtgagtggggaaggagcctgcagaggggtgcggtggagcggattcagtcatgaaaagcagcccctgacatgctgtggcatgtccaggagggccgcctgttgccaggacacctcacggggaaacatgcctgcctttggtaaatttaattggtccaccatttaacctttgggcctgtggattcataaataggataaacccaaccatctgagagtaacatctccccagccccggtcagttgcagattcatattacccaagccccactgatagaatgggaactatcaaaagagccaaagcacattccccaaacagcccccaactgttcctgtacatagatctataagggaggccaatggtaatgagcaggtttttgtgagtgagggaatcatagacccacgcgtccg

SEQ ID NO: 380797 - DNA, 3316 bp, Homo sapiens
aagtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtaggatacaggttgatgagttgatgagacaggaacttaaaaacttaaagctagctgtggacagagaaagggagcgcccagtgaaagcaggaaagaaaaaggacaagaaaggaaagaaaggcaaaaagaaagagaagaaggcaaagaaggataaagatctgacagctgacaggaccatcgagtctctgtataaggaactggtggaagaaggattactgatccaggctctgaaagtcaacctctctgattacattggtgagtacagctacctggggactactcttcgccaggtgtccatagaacccatgccctccctcctggatgtcagacagctcatcacattgtacggaatctggccattaggttctgcagcagtgcatgagaaagctcctttggtgaaatcgctactgttagccgggccgtctggggtagggaagaaaatgctggtccatgccatctgcaccgaaacgggagccaacctcttcaacttgtcctcctctaacattgctgggaaataccctggcaaaaatggcctccaaatgatgctgcatgcagtcttcaaggtggctcgacagctccagccctccgtggtgtggattgaagacacagaaaaaaccttctacaaaaaagttcccaacgcagaaaagatgaatgaacctaaacgcctgaaaaaacaccttccccaaatcctgaaactcctgaaaccagatgaccggattctgattgtggggaccacacggcgtcccttcgatgctgaactccaatctttctgcaaagtttaccagaaaattattttggtgcccagaccagactatgcttccagatacgttctgtggaagcaaatcattgaacgcaatggaggagtcctcaccagtgccttgaatgtcagctgcctggcgaaggtcactgacggcttcacccaaggacatatagtcgaagtggttaaaggcgtgctcacagatcagagaatccggcggcaaattcataaacctctcactgcagttgagtttattacggcgataaccagcatgaatccagtgtacaaagaggaagaagagagctttaagaactggtatgccaaaactcctctgggtaaaaacgtgccttggcgataacaggaggcagcacagaaaaggcaaaggacaaagggaaaaggaaata

SEQ ID NO: 380798 - DNA, 2247 bp, Homo sapiens
aagtgaggttcgcgagtctctgggtcgcgacgggaaggagtgaaacacctctctgcgcctgcgcgctccgtgcctgcgaagcaaacccggcctcaccttttcctgcccgaagcagaagattctcgcagtcctggtttctccctccagaagaccccccacccaaatcctctgtagctcctggtagtgccctgacccctgctgccaccgtccttcagagagcaacggaagagcttcccggagggcgaggaaaagagggaaagtagccagcaatgtcgaacgcaatgtataataagatgtggcatcagacccaagaagccctcggtgctttactcgataaagagcctcagaagatgattgaaccacaaagaaatcaggttttcatctttcaaacattagccaccttctacgtaaagtatgtgcagatctttagaaacctagagaatgtctacgaccagttcgtccacccccagaaacgaatactgatcaggaaagtcctggacggggtgatgggccgcatcctggagctgaagaacgagatggtggagctggaactcacggagttccattatttcgatgatatcctgcaggatctcaagctggccccccaacaattagatattcccatacccaagtattttttgaaggagaagttggaagtaataaaaggaagagagaaaattcttgctcaaatattagcggacagcggaatagatacatctgacatgaaataccctgtaaagagtatccctttcgatgaggctgttaaattaatccagattgctgagagggcacggcaaggtcgcctaagggctttattcatgaagcaaatctatctgcaagaatatagagcaaagcaatccaagatgcttggcaagaaagtgacagatacctgggctgctgcactccgcattcagaaggtttggcgacgtttccatcaacgtaaggaaactgaaaaactgagagaagaggagatgatcttcctgggtatgaatccacctcctctctttaatgaagtcagtgctacagtaatccaggctgaaaaggtggaccgcctgcggaatgaggtgcagataaagcatgaagaggactacagggaagccctggttaccatcaagaatgacctaaagttgatagaaggcgtggatatcaaggagaaccttcaagaccagatccggcattggttcatcgaatgcagaaatttaaccgggacatttcctgactaccctgacgttgaagaaggagggtcagctattattttttctgacaagaccatacaacaggttattgaggatatcatagcaaaccaagaggaagaagaaaaaaacaaaaagaagaagaagaaaaaggaaaaacaacccaagaaagccaaaaaacaaaagaaaggaacaaaggagaaaaataaggaagaagacgaaaaatggaaaatgtcaccaagtctttttcttcctgcaatgaaggaaggatgtaacgcatacaaagaaatctggatgaaaaaagatgagtcttggaatttctctcaggactatgatccagaactgatcaaagaggagaaacgaaaagaattacagtcagagatcaggatacaggttgatgagttgatgagacaggaacttaaaaacttaaagctagctgtggacagagaaagggagcgcccagtgaaagcaggaaagaaaaaggacaagaaagggaaaaggaaataaaagaaagagaaaaaggcaaaaaagaaaaagtaatgcctttctgaagaaccatgcttgagtctctctgggatggagaggaccccaactcgccaaagaaaagattcaccattgcccgcctgaagaagccctcaggggaaggaacttagcagtgtgcaggtgagctgatgccgcaaacccgctaaccactgcatgtgctgttatgcctttcccaggctggacacctagctgggtgttcatcataactttccacagctttaatccacgccaagtttgtatataactgaaattcactcttgacaccctccacagtctttccaagttggactcttcctctcatcagtactagttgtcaaatttaaaatgtgacagttaaagaatattctagtttgacaattagtaagcaatgagtatatcatcagtacactagctttttattaatccatgtacactgtatagtatcttgcatctattttaataaattaattctttgctctagtaatagattttatataatgaaataaaggtgttgtccttgaactgaaagtaa

SEQ ID NO: 380799 - DNA, 845 bp, Homo sapiens
ttttatgactataacattaccaacagatctataaaagtacagtgtacaacaggaatgaaacttatttaacttaatgaccaacaaatgattgacagcagcttgatctgatgccatgacaactgatacatgaagaaaaaacaagggtttgcattcatgttcacatttgttaatacagtccctcaattatccagaaggcagattgggctatcagtttcctgagggacaaagctggcaaaagatttgctgaggactgttctcaattgctctgggaatttaaaacactttcatacacattgtctagttcagtggttctaaactgggggtgatttttcccgggcagggaatgttgggcgatgtctggagacatttttaattgtcatgattagggtacattactggcatctagtgggtggcagccaggcatgttgctgaacatcccacaatgcacaggacagccccacaacagagaattagccagccccaaatgtgagtagtgccaagcttgagaaactggcctagtttgaagtttacacatacaaagaaagaaaagcgaatctctatcaagtgtgtagcatggggtaggccctgttctaagtgcctcacttgaattaactcatttattaatcacagcaaacctatggggtaagtactattcttactcctgtgtaagcccgcataggtcattaggtggggaggtattatatacccactgaacagattagaaagttgagactcagcttattagtggaagcaccttggctccttctttgttgataataccactgccaactcatttttaggacagcagccctaaggctggtcatactctaaagcaagcttgtcca

SEQ ID NO: 380800 - DNA, 2912 bp, Homo sapiens
  misc_feature (1059)..(1059): n is a, c, g, or t
ggagttagaattgagagacttgaacgtggagatggaggtcaggctgcagtgcgatgggatcatctatggagcatatgaggagaagagaatctggaggaggaggagggggagccagcaggggagcagctgtgggttggaggaagccaggagggagagtgcaatgccgagaaagcaatgaagagcgtttcgaagcatgccagcagaacccaatgctgcaaagaggcctgggaatgggattgctgagggcccttctcacagtgagcccctcaagagcagcgtcaggggattgtggggactgttggcacacagctggctttgctaggttgaagacaatgggaggtgtggaagacttgttgacgcatttaaagaagattggagggaaaggtaggattgagagtgtttcagacagaaaaaggattatatgctgagggtaaagcacaagtacagagggttgcagatagtgcagaagtctttaaaaacaattattttaacccaacttccagggagactgaatttcttctgccagtcagtaacaccatcaacctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgcngggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaattcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtccagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctcttaaaaaataaaaaataaaaagtctaagaggatacacagaaatttttaagtggttacctccacggaatgggattaggggatcagaggtgagggaactcatggtttggctatttctcgttctttctgcactgtttcaaatttttacaagtgtatgttattgtacttttaaaaagattagcttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcaggtgaggaaggaactctgaactctcacaatcttgtttcttcatttcccagagagaaactcggcaaagagaaaaaggacatttccctccaggttatctgaaagaatttcaatgcttacctttaatcatgtgacattgtttatcttggattaaaagaaaagaaaatgtatttattttgtgcatattttcaataaaatatataaaatcga

SEQ ID NO: 380801 - DNA, 2966 bp, Homo sapiens
  misc_feature (1059)..(1059): n is a, c, g, or t
ggagttagaattgagagacttgaacgtggagatggaggtcaggctgcagtgcgatgggatcatctatggagcatatgaggagaagagaatctggaggaggaggagggggagccagcaggggagcagctgtgggttggaggaagccaggagggagagtgcaatgccgagaaagcaatgaagagcgtttcgaagcatgccagcagaacccaatgctgcaaagaggcctgggaatgggattgctgagggcccttctcacagtgagcccctcaagagcagcgtcaggggattgtggggactgttggcacacagctggctttgctaggttgaagacaatgggaggtgtggaagacttgttgacgcatttaaagaagattggagggaaaggtaggattgagagtgtttcagacagaaaaaggattatatgctgagggtaaagcacaagtacagagggttgcagatagtgcagaagtctttaaaaacaattattttaacccaacttccagggagactgaatttcttctgccagtcagtaacaccatcaacctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgcngggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaattcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtctaaaatagtgcttgctttatgataggtgctcagtaaaggttgtcttgaattgagcagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctcttaaaaaataaaaaataaaaagtctaagaggatacacagaaatttttaagtggttacctccacggaatgggattaggggatcagaggtgagggaactcatggtttggctatttctcgttctttctgcactgtttcaaatttttacaagtgtatgttattgtacttttaaaaagattagcttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcaggtgaggaaggaactctgaactctcacaatcttgtttcttcatttcccagagagaaactcggcaaagagaaaaaggacatttccctccaggttatctgaaagaatttcaatgcttacctttaatcatgtgacattgtttatcttggattaaaagaaaagaaaatgtatttattttgtgcatattttcaataaaatatataaaatcga

SEQ ID NO: 380802 - DNA, 3014 bp, Homo sapiens
  misc_feature (1059)..(1059): n is a, c, g, or t
ggagttagaattgagagacttgaacgtggagatggaggtcaggctgcagtgcgatgggatcatctatggagcatatgaggagaagagaatctggaggaggaggagggggagccagcaggggagcagctgtgggttggaggaagccaggagggagagtgcaatgccgagaaagcaatgaagagcgtttcgaagcatgccagcagaacccaatgctgcaaagaggcctgggaatgggattgctgagggcccttctcacagtgagcccctcaagagcagcgtcaggggattgtggggactgttggcacacagctggctttgctaggttgaagacaatgggaggtgtggaagacttgttgacgcatttaaagaagattggagggaaaggtaggattgagagtgtttcagacagaaaaaggattatatgctgagggtaaagcacaagtacagagggttgcagatagtgcagaagtctttaaaaacaattattttaacccaacttccagggagactgaatttcttctgccagtcagtaacaccatcaacctgggagttgcccctgacccctccagtcttagctcctgctcctgtaacaaaataccacaaactggttagcttatagagaacagatgtttatttcttacagttcaggagtctggaagtccaagatcatggtgccatcatggccgagttctggtgagggccctcttctgggatgcagcggccagcttctcatgttctcacagtgggtggagggtaagcttgctctctggcctcctcttaaaaaggcactaatcccattcatgagggctccaccttcatgacctaattacctcccaaagatgccatctccaaacaccatcattctggggattccatttcaacatgatttgggggatacatcagaccataacacttttctttttctcaaccttcacatccagttggttctcaagccctggcgattttacgcgctagataggtcttaagttcatctctacgcctgccctggttaaggttctcatcatttctcctctggattcatctgcaacacaggctgcngggttggttcccacctcctagagctggaagagtgggctctctgattctttacacccccgcctcaatcctcctgctgcctgaataaccatctccccgtgacctaggatatatcccagccccttagaggcatgcaaagccttccatgtctgaccctgcctcatgtcttggaagccctagactgctgctgtaccctgaaggaggtacctgctcacattggcccctctgtctggaataaccccaccccggttccacccaattcaggaaagcttcccaacccctccctcccaccaccccaaagctaagtgaagtgacccctcttcttgcctctgtaacaccgccatgcacatttcatacagcccttgctgaaacttcatctagttctctgttagacttaacattccctaagggcaggtttggaaccttactcatctttatatggcgtctaaaatagtgcttgctttatgataggtgctcagtaaaggttgtcttgaattgagcagatcctctagggacaggagttggatggagagcagactgtaaagcctcatgagggcaggggccctgcctcttcctgagctcaggatacccagagcctagctcagtgcctgccatgaaattgttcactccatcaagccttgttaaatgagttcggggcggggggagcatgatggttttctctctctcagaaagaaagcgctgtatcaaagccctagcaccctctctacacccaccttcagtatttcatattagatgcggcccaagtgatactttctttaccgtcccgtgaagacagcatattggcagccctgcaaaaacaaaacaaaacaaaaccctcagttcatggcatacttgctataaatcagctatgtgtattgtcaaattgtagaactgaaagtatattctgattcggtgtgtgtataaggaaatatacaccagtatatgcattaaaacgtcaagaagagctgggcacagtgtcacatgcctgtaaacccagctattcaggaggctgaggtgggaggatcggttgaggccaggagtttgaggctgcagtgagctatgattgcacagctgcactccagcctgtgctgagacctcatctcttaaaaaataaaaaataaaaagtctaagaggatacacagaaatttttaagtggttacctccacggaatgggattaggggatcagaggtgagggaactcatggtttggctatttctcgttctttctgcactgtttcaaatttttacaagtgtatgttattgtacttttaaaaagattagcttggcaacaagtctagcctgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatcccttgcttttaagtattattatagacttttggagactcacgaaacaagcaatccctaaattctcgcccaggaaagtatcttggattaaatggtttttgagaaccttgagagtgtatattctatgaaatggaagaaacaagaactagacagagtcacaaatgctgttgatcacagacaatctctgccatccataaggtaaatgtaatacatctggcgacctgctgagtgtgaacttgcagcaggtgaggaaggaactctgaactctcacaatcttgtttcttcatttcccagagagaaactcggcaaagagaaaaaggacatttccctccaggttatctgaaagaatttcaatgcttacctttaatcatgtgacattgtttatcttggattaaaagaaaagaaaatgtatttattttgtgcatattttcaataaaatatataaaatcgaaaaaaaaaatagtgccaaataccattaattaaaaatattttaacctga

SEQ ID NO: 380803 - DNA, 370 bp, Homo sapiens
gataattttcaggtttctgaggctttgtgtgtgtgtgtgtgtgtgcacgcgcatgtgtgtgcaggtgtgcacacaaaacaagtgtgttttccccttttgcatgtgaaaagaaggtcttaataatccctagtttatagttcctagttcctatttcatttaggtaattggccttatgagaatgtttaatagatgaaatgctttgttctgaattggtatatattttatgtaaaattcctgtaagaatagtttgggatttaaatttgtattttatatattggttatatgattatgaaaattaaattgatgattaaatgcagatataaaaataagttctgagccgttaataaaggtttctaaataaaaccgatca

SEQ ID NO: 380804 - DNA, 613 bp, Homo sapiens
  misc_feature (565)..(565): n is a, c, g, or t
tgttggttctccagaaattccctgattgtaaaatatctgatctcgtgaaaatgaagtcagcacttcccagaagttgagaggcctgaagggggagtaaaaaccgatttcaaatcctgcctggagggaacctgctcaggaggtcctggaaggtggaggcaggctctcatcgcctgtctttattaaataaagccctaaagccctagactgtggtgctcgaaactttttaagggatgcctgactcctcaagaagtctgtaccatttgaatgagctctagttgaaagaaaggtttttataatatattcaaagtggaaatctttcttactttgtttttttgtttgttttttgagacgaggtcttgctctgtcacctggatgaagtgcagtggcacagtcttggctcactgcagccttaaactcccaggctcaagtgattcccctgcctcagcctcctaaatagctgagactataggtgtgcaccactgtgttgcccaggctggtcttgaactcctggattcaagcacccacctaccttgtcctcccaaagtgctgagactacagacgtganccaccagccttgtcctaataaaattaagttgtatcattaaaaaaaaaa

SEQ ID NO: 380805 - DNA, 113 bp, Homo sapiens
  misc_feature (63)..(63): n is a, c, g, or t
aactcctggattcaagcacccacctaccttgtcctcccaaagtgctgagactacagacgtganccaccatgcccagcctctttctttcccatttttgagaagagtggagctaa

SEQ ID NO: 380806 - DNA, 745 bp, Homo sapiens
tgtgtctttaactaggacttctatttggaactgagtccgacagctcaggactggctgctcaaactccacaatttaatgaaaaatctcagatgatgactcagaaaacctctaatgatctgaggaatatattaagggattccagagtcaaaggctgatcatggagggcattgatgagggaagacttcaggtggctggagaccagaagaaaggaacactggaagaatgaaaacggttgtgatgcactgcagtgtgaaaatatgcccttgagccttaaagaaaggggcttaaggccgggcgcggtggctcacgcctgtactcccagcacacagatcacgaggtcaagagatttgagaccatcctggccaacacggtgaaaccccgtctctactaaaaatacaaaaaattatgtgggagtggtggcgcacgcctgtagtcccagctactcgggaggctgaggcaggagaatcgctggaacccaggaggcggaggaggttacagtgagccgagatcgcgccactgtactccagcctggcgacagagcgagactccgtctcaaaaaaaaaaaaaaaagaaaaagaaaagaaaggctactttcatcgctactgcacatcctctaagtaggttaaggaagatttacttagtagagcctcaagatggatttaagttatggataagaattatttataactaggatatcattcagtattataagtgtctgcagttacttaaggatgctagaaacagt

SEQ ID NO: 380807 - DNA, 691 bp, Homo sapiens
tgtgtctttaactaggacttctatttggaactgagtccgacagctcaggactggctgctcaaactccacaatttaatgaaaaatctcagatgatgactcagaaaacctctaatgatctgaggaatatattaagggattccagagtcaaaggctgatcatggagggcattgatgagggaagacttcaggtggctggagaccagaagaaaggaacactggaagaatgaaaacggttgtgatgcactgcagtgtgaaaatatgcccttgagccttaaagaaaggggcttaaggccgggcgcggtggctcacgcctgtactcccagcacacagatcacgaggtcaagagatttgagaccatcctggccaacacggtgaaaccccgtctctactaaaaatacaagaggcaggagaatcgctggaacccaggaggcggaggaggttacagtgagccgagatcgcgccactgtactccagcctggcgacagagcgagactccgtctcaaaaaaaaaaaaaaaagaaaaagaaaagaaaggctactttcatcgctactgcacatcctctaagtaggttaaggaagatttacttagtagagcctcaagatggatttaagttatggataagaattatttataactaggatatcattcagtattataagtgtctgcagttacttaaggatgctagaaacagt

SEQ ID NO: 380808 - DNA, 889 bp, Homo sapiens
taacttactgcgcggccataaaatttaggtctgtcgggaaaattatctagtccagtcaccttattttaaagtgaaaagctatagtctggagaggttaacagttagtggtgagctggagtagagaataactttggccccagaaagagctgtgttccaatcctggctctgtcctttgtgagctgtgtgactacagaccagtgactcaatgtctctagacttgttaatatagaatgagaagaatgatccttagtctcatgggaacatactgattaaagtatgtgtgtaacctacacttctgctcaacattcggcatgccaaaaccatctcattatagtcagctgtccccaaattacaaatggacgatttcaaactttggccgatgagtctgttctttatgatttgaaataatgctgtaagtgatgagtaggtcaccaagatgggcccccaagtccagtgaacagagaccttggaaaactgcagtgtacttctagacttctctgaattccttatacattccaaatgtgcaaaatccccaaggaaatcgcgtttttcagagagctgagcaatcagatctttaggccttccaccctcacaaatgaagttaatatactactaggtcaatgacatcaggaacacaataggtttgcatggtgcttaattctagtatccttttctatctgtttgtttgtttgtttgtttgtttgaaacagagtctcattatagtcagctgtccccaaattacaaatggacgatttcaaactttggccgatgagtctgttctttatgatttgaaataatgctgtaagtgatgagtaggtcaccaagatgggcccccaagtccagtgaacagagaccttggaaaactgcagtgtacttctagacaactccg

SEQ ID NO: 380809 - DNA, 454 bp, Homo sapiens
ccaaaaccatctcattatagtcagctgtccccaaattacaaatggacgatttcaaactttggccgatgagtctgttctttatgatttgaaataatgctgtaagtgatgagtaggtcaccaagatgggcccccaagtccagtgaacagagaccttggaaaactgcagtgtacttctagacttctctgaattccttatacattccaaatgtgcaaaatccccaaggaaatcgcgtttttcagagagctgagcaatcagatctttaggccttccaccctcacaaatgaagttaatatactactaggtcaatgacatcaggaacacaataggtttgcatggtgcttaattctagtatccttttctatctgtttgtttgtttgtttgtttgtttgaaacagagtctcactctgttgtccaggctggagtgcagtggcgcgatctcggctcactgcaacc

SEQ ID NO: 380810 - DNA, 450 bp, Homo sapiens
gatgtctgcattttccagaataaatgactttctctcccttaatttctacttttagaatcttaatgagcattgagttttggagacagtgaccttgttttcaagtgtaggaattaattactttaaaaatgtcactgtttaaaggaatatcagcaccctgttctcactcatgaattatcaccacataaaatctcacaaagattatatgaatctcttccaacaaaatggtttgcctttttatgtgcagaggatggtcctgggacaattgcaacaaaatcatttgggtggggagaggtgattattacaaatacataatccaggtccccactgcagaccaacaaaccggaatctataggatccttagagctgctgctgctgctttatttttttgaggcagttttactctgtcacccaggctggagtgcagtggctcaatcttggttcactgcaacc

SEQ ID NO: 380811 - DNA, 461 bp, Homo sapiens
acatcatgtaggtttgtataagaacactctatgatgtttaaacagcaattaaattacctaatgatgcatttctcaaaatgtatcctctgctgggtgccatgactcatccctgtaatcccagcaatttgagaggccaagatgggtggatcacctgaggtcaggagttcaagaccagcctggccaacatggtgaaaccacgtctctgcctaaaaatataaaaaattagccagacatggtggcgggtgcctgtaattccagctacttgggaggtggaggcaggagaatcgcttgaacctaggaggcagagctttcggtgagctgacatcacgccattgcactccagcctggacaacaagagccaaacttcatttcaaaaaataaataaataaaaatgtaatttttcatcaataagtgttgcatgactgtatgtagatattctcaataaaatcctttaacagata

SEQ ID NO: 380812 - DNA, 357 bp, Homo sapiens
gtttacattgataatagtaattatatatagtgtgattacagcacatagataaataaaatgaattcagcaatgtcataaggaataagaaaagggaatttgaaatgctctaatataaggtacatgcactatacgtgaagtggtatagtgttatttgaaggtgaacttagattagttaaaaatgtatagtgcaaactctagggcaatcataaagatatttttaaaagaagtataactgatgctatagttcagatacttgaacctccaaacctcatgttgaaatttgatccccagtgttggaggtgggatctagtgggaggtatttgggtcataggggtgagtttctcatgaatatattaa

SEQ ID NO: 380813 - DNA, 387 bp, Homo sapiens
aacctctgcctcccgggttcaagtgtttctcctgcctcagcctcccaagtagctgggattacaggtgcacaccaccacgcccagctaatttgtgtatttttagtagacacggggtttcaccatgttagccaggctggtctcgaactcctgacctcaagtgatccgcccgcctccacctcccaaagagctgggatcataggtgtgagccactgcacttggccaatttcctaatttttacagcagaacaagaattaggaaaatgtgtagatgaggaaactgaagcccagagtggcaaagaaacttgcccaacatcacacagagccagagtgagaactctagccttctggctcctaatccagggcttgttccttcagcccacagccttcc

SEQ ID NO: 380814 - DNA, 832 bp, Homo sapiens
gatattcagggttgttttatattgctataaaccatcattatacaacaaaatggtaactgaagttgctgagttactacaatatagactggcagggcaaagtaacaaataattttgaagtttgccaagaatcatttttaaagcccttagcaggcttctgtgccactggtgctgtttgactgtgcattgtctcaatgtggtatagtccctttttgttatcttggtgctttctccctttttcagttgtgttgtttcgtcactcaggaaaagcacctttctacacctgcctgcatttaacataactcgatttttttccctcccttttgcagcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380815 - DNA, 2642 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 380816 - DNA, 3098 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaaaaaaaagacctccccagcccctagcccaggagagagaaagccaggcaggtagccagggggactagcccctgtggagactggggggcttgaaattgtccccgtggtctcttactttcctttccccagcccagggtggacttagaaagcaggggctacaagagggaatccccgaaggtgctggaggtgggagcaggagattgagaaggagagaaagtgggtgagatgctggagaagagaggagaggagagaggcagagagcggtctcaggctggtgggaggggcgcccacctccccacgccctcccctcccctgctgcaggggctctggagagaaacaataaagagattcacacaaaaaaaaaaaaccggaattaagcc

SEQ ID NO: 380817 - DNA, 678 bp, Homo sapiens
tggacaatttgtcattgaacagtttaaaaatatgtacttttaatacaaagataaattgcctaatttttaatatttatgttaattttgatagaactttctttttgccattaatagtcattattctttcctataaaataaatttgtgtttaaaacaggttttctaatctttacctgttttctcctgatattttagggtagtcaatcagtaccaagaattagtccagaatgaagccaaatgtccggtcaagatgtcacacagctccagtggctcagccagtctgagtcaggtttctccagggaaagaaacagatgtgtgtttcattaatgttacttctttgtgcccagttgtttcacaagtaatctgagaaatgttaagaatcatttttggaggctaggcacagtggctcatgcctgtaatcccaacactttgggaggccaaggtgggtggatcacctgaggtcgggagttcgagaccagcctgaccaatagtgtgaaaccccatctctactaaaaacacaaaaattagctgggcatggtggcacacacctgtaatcccagccactcgggaggctgagacaggagaatctcttgaaccccggaggtggaggtttcagtgagccgagatagcgccactgcactccagcctgggcaacagagcaagactccatctcaaaaaaa

SEQ ID NO: 380818 - DNA, 447 bp, Homo sapiens
aaatttattctgaaatgtctatgatttgatacttaagattaatcatactgctaacttttctattatttcattttctatgttgtccttttctaaccctggtagccttcaaactttttgactggcctgctttccccttctcctctctgtagtgttgtctcagcttggctctgccgagaacagacctgagcaaagccttcctcagcagagattccagctctcctctgcctttcaacagcagcagcaacagatacaagtaatccagcaacttcactctgattacatttttaaagatactcagctccaaaagtacctcaaaataacttgctttagttttattttactgtcttttaagactgtacagtaattggtaaataatttagcaaattttaaagtctgacattttagccagtcaacttggagcactgaatatattttgtatatttaagc

SEQ ID NO: 380819 - DNA, 4745 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccaggcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380820 - DNA, 4948 bp, Homo sapiens
  misc_feature (2040)..(2040): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacaggctttggtatcaggatgatgctggcctcataaaatgagttagggaggattccctctttttccattgattggaatagtttcagaaggaatggtaccacctcctccttgtacctctggtagaattcggctgtgaatccatctggtcctggactttttttggttgtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380821 - DNA, 4890 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380822 - DNA, 4732 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtaccctatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380823 - DNA, 4812 bp, Homo sapiens
  misc_feature (1904)..(1904): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatgtgtgtttcattaatgttacttctttgtgcccagttgtttcacaagtaatctgagaaatgttaagaatcatttttggaggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380824 - DNA, 4668 bp, Homo sapiens
  misc_feature (1760)..(1760): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380825 - DNA, 4580 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 380826 - DNA, 2791 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccaggcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380827 - DNA, 4750 bp, Homo sapiens
  misc_feature (1842)..(1842): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380828 - DNA, 4164 bp, Homo sapiens
  misc_feature (1256)..(1256): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacgcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380829 - DNA, 4799 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctggtaggtatcttcataactttatatgctgaatttactaaacatatctaatctatttgggatctcaccgcttaaattattttcttttccttcccttgcaaccagtaaacaggaaaaagtaaagctataatgtgtaaactattaaattgattgatggctgagattttttttcattgatagtggattaagagctttgacttaacataattaccacagttgtgtttccttgttacagtttactggcaaaataattatccactttactaggttaccagagctgttttcagtgtttgccaatagttatcttaattaataacttttttgttttcctgggttaagactgaatttttctagattgcataatcttttgtctcgttctggtaacttgtagttgcataaatgacttaagtcttaatggtcaatagcataacttctgtaagtcacttttatcatttaaaaaaaaagattaaattacttctcaacacttccagcagtaaatggtgaactaaagattactcttaa

SEQ ID NO: 380830 - DNA, 2936 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380831 - DNA, 2732 bp, Homo sapiens
atttatgtaaattgtgtggctgatatgaaaaatgatcctagggtacactggaataaaaaatattttgaaatcttattgccacatgtaactaccagatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380832 - DNA, 1711 bp, Homo sapiens
taactctttataacatgatttttaaatgtacacaaagataaaaggaaaattacagtgaacacctgtgttctagtcatttggcttcaacagctgttattttcctttaatagataagtatggaagagtggaagcttgctttcatcttactcctctgcctttctccctaaaactctctcttcccaccctattactcagaaatcttttcctcattctttatgtgtactgtaatatatttcatgaatctcatgtgaaattttctctgtaatacatatagtattcaatctgtaaccactaagagcactttgcagagttaaaaatctgggatttatagcagtattaattttatttaataaactatgaagttaaatataaatatcatctggggtttatagcagtattaattttaacaagtaagcttaatgtcattgtcttttagcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380833 - DNA, 1614 bp, Homo sapiens
taactctttataacatgatttttaaatgtacacaaagataaaaggaaaattacagtgaacacctgtgttctagtcatttggcttcaacagctgttattttcctttaatagataagtatggaagagtggaagcttgctttcatcttactcctctgcctttctccctaaaactctctcttcccaccctattactcagaaatcttttcctcattctttatgtgtactgtaatatatttcatgaatctcatgtgaaattttctctgtaatacatatagtattcaatctgtaaccactaagagcactttgcagagttaaaaatctgggatttatagcagtattaattttatttaataaactatgaagttaaatataaatatcatctggggtttatagcagtattaattttaacaagtaagcttaatgtcattgtcttttagcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380834 - DNA, 1895 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcagactattttacaccacgacaaacaaacagctttctaatgaaaaggcccaaagataatctgtgaaaaatattctcacaagtgagtcggtagatctcattcaaaattattctaagaggcccaaatttaagaatcttaacaaatcacatttcagatagtatataaaatctaaatatgctttcacattttccagattttgctcaaaaaattaaggacagaaaatcctaatatgaacttga

SEQ ID NO: 380835 - DNA, 751 bp, Homo sapiens
gtacttatatatactaaagtataaattattttcatgtgtaataaactttcaattctgttataaccatgagttttatttaacaggtgttccatttggtttaaaaaatacttcaagtctcaggcccttaaatctactccagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380836 - DNA, 1009 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagaactttaaatttgtggatggaccatttcaataaccaaggtgattaaccaaccaacatggtactccagtaaggaacaaaaaccttttggtttggaagaagcccagcttcaatcccttaactttacaagcttggacaccaacttcttggctttgggaaaccctttcttaaaagccgggtcaaccttggcacttgtgaaaaaccgggacttgggttctttttacccaaggcttaaaaggtattttaccccttttggccccttggcggtggt

SEQ ID NO: 380837 - DNA, 372 bp, Homo sapiens
tttatggccagtatatttttttgaatggtgctcttaaaaattaatgtctatgaagtgatgatagctgccatatccaaacctcccctatattagcctcacaaacactgaccagagagaccgtgtaagcattcttatttagtttgttgttagtaatcaggtgcccaagactcatattttttctttgttatatatatattgatcatagagtggagtggaggagacaaataaaggaaaatatattagacctgttttagaaaacattagaaatgttaaatgtatattaaatttttttgtggaaataactaatattaccaaatatactatttactttttacagcaacaagctttagaactagctttggatcgtgcaga

SEQ ID NO: 380838 - DNA, 420 bp, Homo sapiens
gttaatgctttactaaatgcatgctgagtgcccatatagtttttaggaaaagaaccgtgctgtgctttattctcataggcagacttaaatatctttgtagcctaagtgctgtgtgtcttcctatcgtcagatacatgttactgtatcatttattcctgatttttactaattcttattgcctgcctacttgtgaaggtatttatttgaggtgctatgcatttttcaggatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacagtgagttctgttaaatacaagtaactggaaaaaaaa

SEQ ID NO: 380839 - DNA, 4786 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380840 - DNA, 4865 bp, Homo sapiens
  misc_feature (1957)..(1957): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380841 - DNA, 5090 bp, Homo sapiens
  misc_feature (2182)..(2182): n is a, c, g, or t
gccgcatcccagagcccgctggaggaagacggggtccccagagacccggcaggccggggcggaggttgaggcagctaaactccaggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacaggctttggtatcaggatgatgctggcctcataaaatgagttagggaggattccctctttttccattgattggaatagtttcagaaggaatggtaccacctcctccttgtacctctggtagaattcggctgtgaatccatctggtcctggactttttttggttgtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380842 - DNA, 3796 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380843 - DNA, 4700 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 380844 - DNA, 4555 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccaggcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 380845 - DNA, 3069 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380846 - DNA, 4829 bp, Homo sapiens
  misc_feature (1921)..(1921): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380847 - DNA, 2705 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccaggcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 380848 - DNA, 3420 bp, Homo sapiens
  misc_feature (1878)..(1878): n is a, c, g, or t
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgc

SEQ ID NO: 380849 - DNA, 3463 bp, Homo sapiens
  misc_feature (555)..(555): n is a, c, g, or t
ggtattgagtggcatgtgaagcagatgaagaaggtgacagccagatgtctccatcacactcgtccacagatgatcattcaaatggttcattatggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagtgagtcataacttaaattcttcattaaatcttcataagcttttgcattagtgtttctnaagacagcttttttcaacctgtgaagtagtgatatctgaatgtactgtgtacccaaaatgtataagttgctagaagcttcaggcagagctcttgttgattgtatgtattatgtctctattgtaattgtacttgtttttctgtatctgtgtatgcattctgcgtgtacctttcttataggcttacaacctacacatctccttaaaaaaataacctggtagttacatgtggcaataagatttcaaaatattttttattccagtgtaccctaggatcattttgcatatttatgtaaattgtgtggctgatatgaaaaaaatgtcataagagttgttgctgcaggtcctatctttgtgtatatgtaagaagtcaactagttccaaggtggtgatacaataaactgaaaaacaatatttcaaaaacactcctacactcttttataaattgttgtcagttactaaaatgtgatgataatcataaagcattattctgaagatactgaaatgtaatttttactactgaatacttttttttaacatcaagaagagttatacaagaatgctagcattagtttgggagaatttcttcaaattagtaaatatctgaaagtaccaatttggggaaaaaagtcattccagttttttagattttttatagatagctaatatatgctgaaagttttagtacactgcacagtgatagggtggtcttcgcattagatataaacatcttcatctcgatagctcaaaaggtgtaatttttctgccttcttgttttgcacaaagaaaaatatataaattttctgaaagtcttattcacacttcttatgttgtgggtatggattatggtaatctactgcacacagttgttactttaagtaagggttgagtgacagcttctggacattcacatttctttcctttctttctgcaggacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaattttaatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaa

SEQ ID NO: 380850 - DNA, 2316 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtccatttgttctaaacaatacttcaagtctcaggccttaaattctactcaggttcaggtggttccacttattttaacactctgcgcagacggaacagcagtctccccaggtacacgcaaagaaacttaggggccaaatttgggtgctcacacgccaggagacgctttgggcacgtcaccgtcagaaaggctcattgtcacacggtgtttaaccccggggagaggtttgcaccgagcggagggttgtcgacagtgtgggggacacccatcgt

SEQ ID NO: 380851 - DNA, 1778 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcagcccaagttcctcccgtagccatgtttacgggtctctagcgaacgtttttctctcctgaaacaaccattgtcaacaacaggggtatcctgcccgctttttttcctcaagagtcagctat

SEQ ID NO: 380852 - DNA, 1924 bp, Homo sapiens
agcggagtcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatgtgtgtttcattaatgttacttctttgtgcccagttgtttcacaagtaatctgagaaatgttaagaatcatttttggaggctaggcacagtggctcatgcctgtaatcccaacactttgggaggccaaggtgggtggatcacctgaggtcgggagttcgagaccagcctgaccaatagtgtgaaaccccatctctactaaaaacacaaaaattagctgggcatggtggcacacacctgtaatcccagccactcgggaggctgagacaggagaatctcttgaaccccggaggtggaggtttcagtgagccgagatagcgccactgcactccagcctgggcaacagagcaagactccatctcaaaaaaa

SEQ ID NO: 380853 - DNA, 288 bp, Homo sapiens
attaaccttgaagaccatggtcactttagttctataagcaagtgctaagaccaaagaagtactcaattaaaaatctaactgctggggagaaaggatgtttacaaaagtagaaagatccaattttctagaaagcatttctcttttgattttaatttttggtctgttgaggaaacccacctctgaaataccaattatattttggtgtctaaagcaaacatattaatgttcaattaattactgataccaaatatttatgttcagttttctaaggttgctttaaaaaaaaaa

SEQ ID NO: 380854 - DNA, 316 bp, Homo sapiens
gcacgtcttaagatgatggagcaggaaagagtgaagagggaagtgctacacacttctaaacaaccagatcttgtgagaactcactatcatgagaacagcaagggggaagtccacccccatgattcaatcatctcccaccaggcccttccttcaacacatgagatttgagtggggaccgagagccaaactgtttcactagctaaaattttaccagatagatagttgggtttcataggtattcactaaaaaggaagctcccatattgcatagatctcattgttacagttgtacataaattattcttttattcttttgt

SEQ ID NO: 380855 - DNA, 185 bp, Homo sapiens
taacacatccttctactcttggcacaatatctggtacacagtagttcctactggtagcttgtcataatccatgttagttttagagttaggcatatttgaatttctttacttccatatgtggaattcctttcctctccttttcttgtcctcccttgccacaattttcactatcatgaacatttttt

SEQ ID NO: 380856 - DNA, 597 bp, Homo sapiens
aaatttttttgactctaatttacaaacattaaaaactgaatgagctgcagtagaagcaaggatgaggaggaatgcgcactttgatacatcagtggggaaagtgcaaattagaacagctttgtgtgtgtgtttaggaatacatttaaaagctttagaaggcactaacacacaccaaacatacaccactcagtggttgctggagggccaaagttatatagggaatttaactttctccagatttttacaacattttcacaatgatcatattctgagaggaaaatactttcacattttaaaaatcagctacagagggccaggcatggtggctcacgcctgtaatcccagcactttgggaggccgaggcgggtggatcacgaggtcaggagatcgagaccatcctggctaacatagtgaaaccccatctctactgaaagaaacacaaaaaattatccgggtgtggtggcacgtgcctgtagtctcagctactcaggaggctgaggcaggagaatcgcttgaacctgggatgtggaggttgcagtgagccaagatggcaccactgtactccaacctgggtgacagagcgagacttggtctcaa

SEQ ID NO: 380857 - DNA, 630 bp, Homo sapiens
tggtaatactctcaagagaaatggactttgccctctgaattcctagacaggtaagtcaattcctgcttgattagcaatgctatcacgcatgactcccgcactctttgctgaagataagcagtgaacgagagacacaaatcttgcctcgggcccggcacggtggctcatgcctggccaacattagcatgttaatctttatttatttatttatttattttttttaagacagggtctctctctgtctcccaggctggagtgcagtggcacaatctcagctcactgcaacttccacctcccagattcaagcaattctcctgcctcagcttcccaagtagctgggattacaggcacccaccaccacacccagctaatttttgtagttttagtagagacagggtgccaccttgttggtcaggctggtctcaaactcctgacctcaggtgatccatctgcctcggcctcccaaactgctgggattacaggcatgcgccactgcgcccaggcacatgttaatcttcttaaaacgccaccctgattatgacagtccccaaactggaaaacacacagctttacttcctagaagaccaagtccaaactcctcacctgagcatcctaatgcaatctaccctg

SEQ ID NO: 380858 - DNA, 125 bp, Homo sapiens
atctcaatacatacaggcaaaaggacagatattcttatgttaaggtgtaagtataaaatgctaagcttttatccctagaaattcagcaaaaagatacaggacacctttggcagccctgggaacag

SEQ ID NO: 380859 - DNA, 219 bp, Homo sapiens
agataacttcccatactataggcagttggacaaagatgtaaatgccttgtttacaaatgctacccagatctcctaattaggaccacacatgcggagaacccaacagcttttggacttatcggccaatggtcttcttgggaaggtctctcctagtcatgggaattgtctttttattgttcaagcttttgcatagacctggaagaggcatccattgctgtt

SEQ ID NO: 380860 - DNA, 521 bp, Homo sapiens
tggaaatgagaagaaaaagaagcagagccatcaagtttcgaaggaaaactatttccaaactagaattctatatccggtaaaaccttcaattagtgtcagtatagaataaaaagatagcttcagataagcaatgtctaaaaaaaccatacatccccaggtgtcctttcctagaagctactggatgacgtaaaaaataaaaaataaaaaaccaatgtgagacagtaaatcaagaaagaaatgggccaggtgcagtggttcacgcctgtaatcccagcactttggaaggcagaggcacatcaccttaggtcaggagtttgagatcaacctggccaatatggtgaaaccccatctctactaaaaatataaaaattagttgggcgtggtggcaggcacctgtaatcccagctactcaggaggcagaggcaggaaaattgcttgaacttgggaggcggaggttgcagtgagccgagatcacatcactgcactccagcctgggcgacatgagtgaaactctgtctcaa

SEQ ID NO: 380861 - DNA, 3143 bp, Homo sapiens
  misc_feature (438)..(438): n is a, c, g, or t
  misc_feature (441)..(441): n is a, c, g, or t
  misc_feature (443)..(443): n is a, c, g, or t
  misc_feature (446)..(446): n is a, c, g, or t
  misc_feature (449)..(449): n is a, c, g, or t
  misc_feature (452)..(452): n is a, c, g, or t
  misc_feature (454)..(454): n is a, c, g, or t
  misc_feature (472)..(472): n is a, c, g, or t
  misc_feature (479)..(479): n is a, c, g, or t
  misc_feature (483)..(483): n is a, c, g, or t
caaattttgagtacttgccgtgctgtggaaaacaggaggaggagctgaccagagacttataggaggatgaccaagtgccactgaaggcttgctgaagaccccaagcaatcagtttcccttccttaagcagacctcaagtccagtgcctcaagggataaagctagttgtgggaaggaaaggcaaaggggcagactgtcttgtggctgctaatggctgagggagctgccaccccagttggaggtctgcttagggtcatcctctgtccaggctccacacaccctgggacagtttctggagctgtccctccttgcctagaccctggctggctcctattcatcactaactctagtgatgctccttccaagaagtcttccatagtccccagtcctcctttccagtcctggtaggtggcccttgtcctgtgctaccctttccctntcngnatntgnatnanattactgtcatgaacctnccgtgtncctntcccctccccctctcccctccccctcaccgcccccccccccccccccccgcaaccccttaagagcagggactgttgtttaatctctgcatctccaggatgcagcgagggcctgacatgtggagtttctcggggtatgtttggtgaataaatggcacagggagggggctgctgccaccactgccactctatgctctctcagatgtaaacaggttacccagctgggagagaggacatctgctggctggtgtggcgtccagcactgatgtgtctaccttctctgaaggtgggtccaggagacctttgacccaggggatcctcatcacccctcacctgggaaagctgacacctggtggaagcttggtcctgaggcagggagggagggaagtgtggtcctgaagctgccccatcctcaacccatcccctacagatgccagaggggacccctttctcaaggccgcaatcaccccattcgtttatatagaactttatggcacataagtatctttgacatatgtgaattgagtccgcccaacaaccctgcaaaattggtatgaccaccatcccattttgtggatgaggaaattaaaggctcagagaagtaaagaaatttgccctaagccacccggctagtaagtgacagacccacgacttgggcttaggcctgactacaagttcagggcactttgccactatgctgccctttggcccagctcagctgtgctgaggaaggccaaggtggtggtgaagtttcagggtcctgccacatacccatgccttcctcatcttcccgggggataaagggtacaagaggggaggagagagacacagatcacccatgggtcagcagtgtagtgaggacccaggacttcacagccttgtgtggggaagggaaggaggaagaaatgtgggtaagcctcaggccaagctgctgcactgtgaggccacttggactcacacccacagcctgggctcattcctggctggtggccggtatgaggtctcaccctagttccactcctcgtgggggctggcaaaggcacaatcctcggcctgtttgagggtaacccagccacagcaccccaagccagtgcctgctccctccctcccctaggagtgctggggaatccgaggtaaggtcccttgtcctttgtcgtgtgagtgagattctgggctgtgagaggcgcagagtcgcctcatgggcttacctttgagatagaggcctgaggggacagccgggccttaggcagtgtcagaggtgaggcagtggtggtagaccggggaaactcctgtcttcaggactggcattgagctgagcagcagaggtgggggcctttctccagggcttttccctaaccccaaattctcaccccagcagcttcttcctgtgccctgggaaaggggatgtggtctctgtgctgcctaaaagggtgcttaggctgggggtgggtcattcgaaagcctggggctctagggactggggagagtgtgggaaggtgctgagtgaagagcagggaaaggatcaagaagggggcatgggaagggaggggagtgagaaaggtgtcaggcaggagaaaaaaaggggcttgaaggagaagggaggagggggaagtggggagggaaggacgagtcagaagctaaggagcatgatgcaggccttagctcctggccaggctgtgagagatcagcgtgggccagggcaggtgtaggaactgaggatgctgcggctctgctgctcctggggctgtggggtgccatagcaggagggccttctcctaccaggcgccttgtggagcagggctgccactcattgtcagcacctggttgaggggcaggcaggagctggtggaggcctcccactggagggagaggacagaagtaacagggaatcacaggactgcagggggcttgataagggtctcctgtgtatcagacatggaaccagacactttgctgggacatggggttactctgcggccaagttactactactgaagcagaaacacttcttggggtggacagctggtggtggcaggtgaatttggtgaggttttagcttgagctgtgggaagacccagaggtctgcggctgctactgatgacccagactcctgccccctcaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaaga

SEQ ID NO: 380862 - DNA, 711 bp, Homo sapiens
ctggtgcccacccccagtgcctcgaggtcgaggagagctcctcggccccgcaggacggggaggattctgtacagatgagcataacttatgtaaacaggttacccagctgggagagaggacatctgctggctggtgtggcgtccagcactgatgtgtctaccttctctgaaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaaga

SEQ ID NO: 380863 - DNA, 977 bp, Homo sapiens
gtggcaggtgaatatggtgaggtttaagcttgagctgtgggaagaccagaggtctgcggctgctactgatgacccagactcctgccccctcaggtgactgcaagggagcctgacaagtgccgctggagacacaagcagtgcactgggcacatgatttaccctttgggctctgactgtgtccgccacagtctggatctacactctgtcatgcattgcagggggcttgataagggtctcctgtgtatcagacatggaaccagacactttgctgggacatggggttactctgcggccaagttactactactgaagcagaaacacttcttggggtggacagctggtggtggcaggtgaatttggtgaggttttagcttgagctgtgggaagacccagaggtctgcggctgctactgatgacccagactcctgccccctcaggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaaga

SEQ ID NO: 380864 - DNA, 828 bp, Homo sapiens
agctgggaagactacgcagcctggagccgggctggggaggccggcgggggctgcgccagcatgaggcggggttaggggctaggcggggcgaagccgagactggagttcacggctgggccgagggctcggccgggctgaggctcagggttggacttcacgcaagagtcctgtagagacgaagacctgggcggagagcgatgtgggtcaggacgacgctcacaattgaaagatggactaaggaaaagaccgagcccaaggcccgctcgtgggatgagagcagatgccgcggtgactgcaaggagcctgacaagtgctgctggagacacaagcagtgcactgggcacatcatctaccctttcgcctctgactgtgtccgccacagcctgcacctacactctgtcaaccactgcaactgtaattctaggctgaaggactcttcagaggatagcagcagctcccggggcgcgggcccaacctgctcccatgtcatcgagtccccttgctttgagctcacaccggaggaggagcatgtggagcgattccggtatggctggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaaga

SEQ ID NO: 380865 - DNA, 401 bp, Homo sapiens
aggaggagcatgtggagcgattccggtatggctggtgagtgagccccggtgggctgatggggaaggggcctctacagggcactgccccccactctctgtcaaacttcccccgttgtcccttctcccaggtgcaaaagctacagacctgtctctgtggcagtgatccaccatccactctaccatgagtgtggggcagatgatctaaatgaagaagaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaa

SEQ ID NO: 380866 - DNA, 110 bp, Homo sapiens
gtgcatacctggaaactctactttctgcataatttttctataaacctgaaattgctctaaaaagtaaagtctatttaaaaataataaataagaaagaaatatgaatatca

SEQ ID NO: 380867 - DNA, 168 bp, Homo sapiens
ggctctgagaagagcaacatcattttgagagtggtgctaaaaccctgtaagcctgagtgttctgtcctcccaaagctgtgatacggctcagcctcctgacggtgacctacttggttttatttcttcttgctgtctcagaaaatattctaaagatgcttaatattattt

SEQ ID NO: 380868 - DNA, 1490 bp, Homo sapiens
aatctgtggggtctgcttctgtgttttttttttttctcttcatcagttacatttttctgcttccttgcatgttccataatttttttaagtgtacagcagacattctatttttaaagaaccataaagactgaagttggtcatattttcctccatagagagtttgtcctttccctgctgagtagggtgagaactcatcactttattaggaattgaactgggctagggctaggaagccaccttgattagattcagtgccctgtagtttcaaatgtctacagaatgaggcctgccatatgtttattgtggacttgtctttctcagaattttgtttccaagcatatcaagactatgaaaggggccagactctgtggctcacgcctgtaaccccagcactttgggaggctgaggtggaccaaccgattgagcccagaagttagaggccagcctgggcaatatggtgaaaccctgtctcttgtaaaaatacaaaaattaaccaggcgtagtggtgcatgcctgtgatcccagctactcaggaggctgagcctggaggatcacttaatcccaggaggtcgagactgcagtgagttgtgattgcaccacagcactccagcctgggtgacagagtgagaccctgtctcaaaaaaaaaaaaaaaaaaaaagactattgaaggggttaaccttgtctttctcgccttcctagccccaccttccacccttccatgctgccctagtactcagcaaatgccccatagggcaaactggccatgcatttgggggtttttctagattccaatccgtcatgccatcccaatggctgtcaaaatgtctgttggattctctttcctctagtagagatgccagtacctttagcagggcccagtcctcagctctcatgtttgagaaatgacctcagagaataaggccagctcactcaggaaatgtttttccttcttaagaattttagttaagctaagtcattgcttacatcggtctccagtgtcttcaaagaaaaaaatatatacaatgtgcttacttcctaagttatggtggagtaatggcttgctattgctatgtccaaaaagcaaaagctccattaagttttcaattttaattattatattttgttgtttttcaaaaatgcattgtcatttggtggttatgaattataattatgtttaaaatttttttcatttatttatgtaaacatatcaaacagctttatattctgtatctgatagttccagtaatctaataatctttataaatatttctattgtttctgctgactcttgctaatggtgctttattcccctatatttttcatgatgtttatgtatgtgtgtgactttatgctcattaaaactatatgcaaattattcaaggccctaaatgtaaattcttcatgggagaatttgtgtttgtttccatcagacatggggacactaccaattttggtcttctttaaattaaaattctcagcttatacagtt

SEQ ID NO: 380869 - DNA, 1460 bp, Homo sapiens
ctccatagagagtgtgtcctttccctgctgagtagggtgagaactcatcactttattaggaattgaactgggctagggctaggaagccaccttgattagattcagtgccctgtagtttcaaatagagagtttgtcctttccctgctgagtagggtgagaactcatcactttattaggaattgaactgggctagggctaggaagccaccttgattagattcagtgccctgtagtttcaaatgtctacagaatgaggcctgccatatgtttattgtggacttgtctttctcagaattttgtttccaagcatatcaagactatgaaaggggccagactctgtggctcacgcctgtaaccccagcactttgggaggctgaggtggaccaaccgattgagcccagaagttagaggccagcctgggcaatatggtgaaaccctgtctcttgtaaaaatacaaaaattaaccaggcgtagtggtgcatgcctgtgatcccagctactcaggaggctgagcctggaggatcacttaatcccaggaggtcgagactgcagtgagttgtgattgcaccacagcactccagcctgggtgacagagtgagaccctgtctcaaaaaaaaaaaaaaaaaaaaagactattgaaggggttaaccttgtctttctcgccttcctagccccaccttccacccttccatgctgccctagtactcagcaaatgccccatagggcaaactggccatgcatttgggggtttttctagattccaatccgtcatgccatcccaatggctgtcaaaatgtctgttggattctctttcctctagtagagatgccagtacctttagcagggcccagtcctcagctctcatgtttgagaaatgacctcagagaataaggccagctcactcaggaaatgtttttccttcttaagaattttagttaagctaagtcattgcttacatcggtctccagtgtcttcaaagaaaaaaatatatacaatgtgcttacttcctaagttatggtggagtaatggcttgctattgctatgtccaaaaagcaaaagctccattaagttttcaattttaattattatattttgttgtttttcaaaaatgcattgtcatttggtggttatgaattataattatgtttaaaatttttttcatttatttatgtaaacatatcaaacagctttatattctgtatctgatagttccagtaatctaataatctttataaatatttctattgtttctgctgactcttgctaatggtgctttattcccctatatttttcatgatgtttatgtatgtgtgtgactttatgctcattaaaactatatgcaaattattcaaggccctaaatgtaaattcttcatgggagaatttgtgtttgtttccatcagacatggggacactaccaattttggtcttctttaaattaaaattctcagcttatacagtt

SEQ ID NO: 380870 - DNA, 1436 bp, Homo sapiens
aatctgtggggtctgcttctgtgttttttttttttctcttcatcagttacatttttctgcttccttgcatgttccataatttttttaagtgtacagcagacattctatttttaaagaaccataaagactgaagttggtcatattttcctccatagagagtttgtcctttccctgctgagtagggtgagaactcatcactttattaggaattgaactgggctagggctaggaagccaccttgattagattcagtgccctgtagtttcaaatgtctacagaatgaggcctgccatatgtttattgtggacttgtctttctcagaattttgtttccaagcatatcaagactatgaaaggggccagactctgtggctcacgcctgtaaccccagcactttgggaggctgaggtggaccaaccgattgagcccagaagttagaggccagcctgggcaatatggtgaaaccctgtctcttgtaaaaatacaaaaattaaccaggcgtagtggtgcatgcctgtgatcccagctactcaggaggctgagcctggaggatcacttaatcccaggaggtcgagactgcagtgagttgtgattgcaccacagcactccagcctgggtgacagagtgagaccctgtctcaaaaaaaaaaaaaaaaaaaaagactattgaaggggttaaccttgtctttctcgccttcctagccccaccttccacccttccatgctgccctagtactcagcaaatgccccatagggcaaactggccatgcatttgggggtttttctagattccaatccgtcatgccatcccaatggctgtcaaaatgtctgttggattctctttcctctagtagagatgccagtacctttagcagggcccagtcctcagctctcatgtttgagaaatgacctcagagaataaggccagctcactcaggaaatgtttttccttcttaagaattttagttaagctaagtcattgcttacatcggtctccagtgtcttcaaagaaaaaaatatatacaatgtgcttacttcctaagttatggtggagtaatggcttgctattgctatgtccaaaaagcaaaagctccattaagttttcaattttaattattatattttgttgtttttcaaaaatgcattgtcatttggtggttatgaattataattatgtttatgatagttccagtaatctaataatctttataaatatttctattgtttctgctgactcttgctaatggtgctttattcccctatatttttcatgatgtttatgtatgtgtgtgactttatgctcattaaaactatatgcaaattattcaaggccctaaatgtaaattcttcatgggagaatttgtgtttgtttccatcagacatggggacactaccaattttggtcttctttaaattaaaattctcagcttatacagtt

SEQ ID NO: 380871 - DNA, 211 bp, Homo sapiens
aggaaggaaggaagaaaaaaaaattgtgtatcccaaaatgtctctccagaagatacgatagaagaagtctgtaatgactgtatttaggtacactaaaccagcagtgcatatctgcaaattggtcatgagatgtgagaaagaaaggtaagaaaagtatatctaggaaggtactaggttagttaaattaagttgatttctgtctaatgtaaga

SEQ ID NO: 380872 - DNA, 339 bp, Homo sapiens
acctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttatggaa

SEQ ID NO: 380873 - DNA, 365 bp, Homo sapiens
ctgtggttgcagatagtaaatgctattaaaagaaagagcgtctgtaatactggagcttgacaacagcagcagataaggaattttcctgaatttttatttcctgctagtgtggggacaggagtggtggctggatgtcaggggagagttcgggtttgttggtctcattttctgtcttatgtggctgaggaagcggttgtctgtatgtttttgatgcagtcatatgtcatagtttggacgttctcttgcagggagggcaccgctagtcaatgagtggaacctcgatttaaaggtctttttatgaaacggattttcatgtgaagcgtgtaactcttacagatatttgagtaaacctcaggctcattgtt

SEQ ID NO: 380874 - DNA, 458 bp, Homo sapiens
acaggcatgatccaccatacctggcctaaatgattctgaaagcatacatctgctatagtagttctaaactaaagttgcaaagttagtgaatgatttactttaataaataaaaaaaagcacaggtttagtattacctcataacgttgcttgtatcattgtattcctatattctcttaaatgtaagtgattagagtactcaagatacttaaaatcttttccataatagagtatgatgtatttaaaaagtagagacaaatgacgttttaaagcttgtgtaaaccatctacagcttttgtgtttcgtggagtcattcatttgatgatgtctgatcaatatatatgaatgtcctgtttccacctctggtacctattcatttgacagtgagataacatgcattaaagaaacctcatggtatttacatatcagctgaatgaagcaacactcacacctttaattag

SEQ ID NO: 380875 - DNA, 600 bp, Homo sapiens
tctcagctccgataagccagataggcagataataacaacacagtgtgtttgggcttaggacggaggttatgggagcctgaactcagcctggttggagaatacttcctggaggaaatagctgaagctgggaaattgcacttggtgggggagttataaagcatgcataaagggccagaagtagtgaaacttgatatcgttcagaaaaccagaaacagattgcatagggcatgtttgagaagctgagccatgaggcgtaaatcctggagatggtggtggagatagggagaaacggacaaagtggacaaaggacaaagctctaggatgatggctgaggggtagaagaaggggcaagggagacagaggtcttggagatgacgcccatatctctggcatgagcaacccagatggcagggggtggggcctggtttgtgggaaggggtgtcccactagcagatgtgtacccagtggaggtgcagctcagattggagctggccatgggtatttgaaaatcatgtgcgcacaggtagccactgaagccatgggagtggatgagaacacttggaaagtgaactctgggaaacccaatttattagggataag

SEQ ID NO: 380876 - DNA, 708 bp, Homo sapiens
catgggagctgagggatgggtaggaggtcctcctaacttcctgagtttagcttcccaactgcagtggtcttctcaaagctgactgcagagacaggattgaccctgcacacaagaggtctgtctgagattctagagacatagcttatgctcttcacactcttgtgttttgcacacacaggtccttgagttttaagcatggctttttgaccttctcagtattgtcttttatctggagtggaagtggaacgtgactttacccagcctctactgtgagttagggaggggtgttggccccactggccctgacggcatccacacagcctttgctgtcatagagtgacccttctggctcctttgattagtgattggctctcctccatagcaagggctggcaaagggttcctaactctgtttaagtgaaatctgaaacgggttgccaatggtgcctctcttcaagaccccagagccagcctggaaggaacaccatgaaaatgttgcaatagtcaatgagtagaatgtggacttttgtgtcaaccacactaagggtcgtacttttttcattaagaaagtattaacgtgtgttttttgagaagggaggaagaatgtgtgctattcctttattcttgctattaaatcataaagctgggttatataagatcctggaaactcagcctttatgaacagaattaataaaagtttgaaatgtca

SEQ ID NO: 380877 - DNA, 339 bp, Homo sapiens
tggaagagatgttggctagatcacagtaatgagaaaactttctttaaagtaactggaataacatcaagacaaggtgaagatcacacatgaccaggcttcccagaaaacctgggagacagaggcccagctacatagcaaagaattcattaactttattcatgatggaacctcaaacttagccctgtatttcctatgtagcttttgttatgattaagtaatgatttggtctgttatatagtgttcttttcacattttattatgaacttcataccatagctccatttgatttatgctaagttctctttgtggtaaaaatctttaagcctctattttaggtag

SEQ ID NO: 380878 - DNA, 2068 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgttaatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 380879 - DNA, 3052 bp, Homo sapiens
ggagaggggcgcggggtggaattgctgcgggaagtgggaaactggaagtgggaaactggaagtggaatctggtgctccggaaagagacgttcccaacttctactttctccccagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatgga

SEQ ID NO: 380880 - DNA, 3246 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggttcgtaacactcgccacaggttgctcctggtggccgctttctgggttctgagctgggatggcttccagtttcactgcgggaggggaacccgaatcccggtcctcttgggggccgtttcctttcttgattgcagagaaagggcttggaatacgtgcctatgatatgctttggccagtacacgtaacaccagggatgagagatcagttgccaagagggggaaaaggatggctctaggtttttaaatttctgttccttttataggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatgga

SEQ ID NO: 380881 - DNA, 3530 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaaaaaaaaaaaaaaaaaaaaaaaaaaaaaaaaaaaaaaaaaaaaaaaaaaaaaaaaaaaaaaaaaaaaaaaaaaaaaaaaggggggggggggcaaaaaaccccgggggcggccaaaaactataggaaacaccacccacacatgtctgcaaaaaaaccaagggcgccaccaccatataggcgacgcggtaataaaaaaacaaaccaagagcgcacgccacacccagacaacacaaaaccccgctgcactaacgagcagcaacacacgcctcacacgctgacggcacccctcccgcccgacgacaaccccccccccccgcggccgcggcggcaccaccaccgctcgcgcacaccaccacccaccagcaaagaaaaaccgcaacccacgaggagacaacaacaccaccccacgcaggtgcactagggggcccgaacccaccacgccctaatatagactcgccgcagcggcagagcaattgcacccccgccggcgaatgtacagcaaagaacacaacacaccgcggcgcgctgtgctgactgacgcgccgg

SEQ ID NO: 380882 - DNA, 3307 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380883 - DNA, 2500 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctttaggaacatgttttgcttttttaaaatatatatatatttataagagatcctttcccatttattttgggaagatgtttttcaaactcagagacaaggactttggtttttgtaagacaaacgatgatatgaaggccttttgtaagaaaaaataaaagatgaagtgtga

SEQ ID NO: 380884 - DNA, 3190 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380885 - DNA, 1833 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatgga

SEQ ID NO: 380886 - DNA, 293 bp, Homo sapiens
caggccattcactaccctggatctgagctttcccatctgtgaaaggataatggatttgccagtgttctttctagtgttgctgagcatagactgaggtgagggacacagaaaaaaaaacagtatatttccttttaaatagtttacctttgtttctgttacacttcagttattagaggaagtaacacaaggggatatgagtgcagcagacacatttctgtccgatctgccaagggatgatatctatgtgtcagatgttgaggacgacggtgatgacacatctctggatagtgacc

SEQ ID NO: 380887 - DNA, 2984 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatgga

SEQ ID NO: 380888 - DNA, 3375 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380889 - DNA, 3321 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagactgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380890 - DNA, 3454 bp, Homo sapiens
gatacttgtgcggttccaagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcctgtatccagccttattgtgggagtggacctggttccaatcaagcctctccccaatgtggtgactctccaggaggacatcacaacagaacgttgtaggcaggccctgaggaaggagctgaagacctggaaggttgatgttgtgctcaatgatggggcccccaacgttggggctagctgggtccatgatgcttactcacaagcccatttgacactgatggctctacgtttggcttgtgactttttggcccgtggtggcagcttcatcacaaaggttttccgttctcgtgactatcagcctctgctatggatctttcagcagctgttccgccgtgtccaggccaccaagccccaagcctctcgccatgaatctgcagagatctttgtagtctgccaaggattcctggcccctgacaaggttgacagtaaattctttgaccccaaatttgcctttaaggaggttgaagttcaggctaagaccgttactgaattggttactaagaagaagccaaaggctgaaggctatgctgagggtgacctcactctctatcaccgtacctcagtcactgacttcctccgagctgccaaccctgttgacttcctctccaaggccagcgaaatcatggtagatgatgaagagttggcacagcatccagctaccactgaggacatacgggtgtgctgtcaggacatcagagtgttggggcgcaaggagctcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaaggtaaggagaggccgggggcaagactgcggggagatgagtcttccttgggagaagggcagctgatgttctcctatcacagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380891 - DNA, 2570 bp, Homo sapiens
cagggaaaggccatgatgttggacctctgggaagaggatattgctgtgctaaaggtttgggatgggggcctgagccttttgatttatgtagccgaagcccgaaaggtgggtagtgagcctaaaacagaagggggcggggacaaagagggagatggcaagatcagtaatagtatctctggggcaggtcgctactaaactggagaacaaaacttcggcgatatgtggccaagaagctgaaagaacaagcaaaggcactggacatcagcctcagctctggagaggaagatgaaggtgatgaggaggactcaacagctggaaccacaaagcagccctctaaggaggaggaggaagaggaggaggaggaacaactgaaccagaccttggcagaaatgaaggcccaggaggtggcggaattgaagaggaagaaaaagaagctgttgcgtgagcagagaaagcagcgggagcgtgtggagctgaagatggatctgcctggggtttccattgcagacgagggggagactggcatgttctccttgtgcaccatccggggtcaccagttattagaggaagtaacacaaggggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagaggaggaggaggaggagaatccactgctggtaccactggaggaaaaggcagtactgcaggaagaacaagccaacctgtggttctcaaagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttgaaggggaagaaaaggatggcatctcagacagtgatagcagtactagcagtgaggaagaagagagctgggaacccctccgtggtaagaagcgaagccgtgggcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaggctagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380892 - DNA, 1121 bp, Homo sapiens
tgtcttattgttcataccacagattccagaacggaaacagcttgccatcccaaagacggagtctccagagggctatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaagagttgtcttttctgacagttttaataagcacttccctatctgtccctacactgtgtgcggcactattcttaatgtgtaccaattcatagacagaaatgacaaacgatccacaggtcccggtagtaaaacatttactagagagcaagcagaaaggaatgcacatcttaaagaaaccttcacaaagtcacaaaagtcaaagtttgtatatttcttttcctttttataaacgataaacaaaaatcatcaaaatcatttcagcaaaagacttttctatcattggggcaagttaaaaaaaatacaatgaaatagaagacactttaaaagctgttgttgggtttcttgtttaattttaaatttagcaataccatctcaaacctggagcaatcctg

SEQ ID NO: 380893 - DNA, 311 bp, Homo sapiens
attctctgactcggctattgagtcccatcaattacaacacatggaaaaaactttggacagttaaaaataacataggggcctggtgtttggaagatctggagtttggaatgccagcttgtcaagcacagatccctgcctaccaaaaagcatgtgctgggaactcacatacacaccaaccagcacaagaaggtcacagatgagcaaggtgcctgttacctaccaccctgacaacagtgtgtcaggccaacttggaggacaaactctcagtcctcagccactttggtctaaaggacttccaagccctcttctag

SEQ ID NO: 380894 - DNA, 397 bp, Homo sapiens
atatactagggaagtaaagagatacatactgtacaacatggaaaaaccagggctatgtcttatgactacacagattactgtgggaacaagagttatccagatttggagtaggggaagtaaggaaggtcaggaaaggctttctgcagaaggtagcaactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttg

SEQ ID NO: 380895 - DNA, 253 bp, Homo sapiens
tggtccagaaatgctgtgtgttcatgggcacatggtggccccaacctcagctgctacagttccacacaggtttcactaggaaaaaagagttcattgcttaaaaaggaagaagaaataaacaagtctgtcaaacactggcatgtatgagcactaagatcatttccagctaaaaataattgaccttctaatgttgggatgataaaggaaacttagatgattaaatatgagataactcttactgaatgctacatgc

SEQ ID NO: 380896 - DNA, 600 bp, Homo sapiens
accaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtgtaatgattattgacaacagggatttcccagatgacccaggcatgcagtgggacacagagcacgtggccagagtcctccttcagcacatagaagtgaatggcatcaatctggtaagggggcagctccctgaatggaaaacctgaggtcttggtcccattcacaccaggtggtttctgtaattttttctgtggccaccctcccacttccagtccttctccagggccactctctaaggaggccagaacttccaatgctcaccattaaacctactgaagaacaaacacaccttttgatatctttacgatcttgtgtgagactgaataactaaattatcagtgctcagatagaggcagaagttttttctaaactgtgtcctccttaacaccctcaagcccccgcctttgtcctcactacatgccat

SEQ ID NO: 380897 - DNA, 386 bp, Homo sapiens
agtgactgctttaatgttaaaaatatttattttttttcctaaaagatcacacaaaagttgggaagagaaggatgtcaattagactacatcaaaatctgggcagagggaggacaaagagctgcctaaagaaactggtagctggagcaaactgcagagatcaagatgaccctagtcaacggaaccagcagcccaggtcagccacattcaggagcaccaccgaggcacggcagggagagcaaagttgctggccccaatcattcctccttttcagggcaggagaggcagaagctcactctttagacatgttcttgatggtcttgtgctctttcatggccttctcccaatcgctgccattgaattcctcagtgaccatactccgcacaggg

SEQ ID NO: 380898 - DNA, 454 bp, Homo sapiens
taaagccccgcccaaccccacattacccataatgtgctaaaagtcttttttaaaaaatctgtattctttaacctggagattttctttctctctttttttttaactgctccttgtagagcagggtgtaggaagtgtgcccagaatagccagagaacttatttctaagagaattgatcctaaagaagaaatttctaaattgtcaaaaatgtataccaaggaggttcaccagtgttgttgataatcagaaaaaaacgggactcaactgcaatgatgcagagacagtgatggggtaagtagaccaggaaatcggctgtggggaagagggagactggggcatggggacagtagggaaagatttttcactgtgtatatacacattttcttctacctttcaaattttgtaccaagtacaaaaaattccccaaaataataaaattaaagttacaaataagta

SEQ ID NO: 380899 - DNA, 363 bp, Homo sapiens
ggcttattgatatcgacaccaagaagccctccacccggtctttgacatgcaagacacattcgttaacccagcgcagggctgtccagggtagaagaaatttctaaattgtcaaaaatgtataccaaggaggttcaccagtgttgttgataatcagaaaaaaacgggactcaactgcaatgatgcagagacagtgatggggtaagtagaccaggaaatcggctgtggggaagagggagactggggcatggggacagtagggaaagatttttcactgtgtatatacacattttcttctacctttcaaattttgtaccaagtacaaaaaattccccaaaataataaaattaaagttacaaataagta

SEQ ID NO: 380900 - DNA, 2121 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctggagcagggtgtaggaagtgtgcccagaatagccagagaacttatttctaagagaattgatcctaaagaagaaatttctaaattgtcaaaaatgtataccaaggaggttcaccagtgttgttgataatcagaaaaaaacgggactcaactgcaatgatgcagagacagtgatggggtaagtagaccaggaaatcggctgtggggaagagggagactggggcatggggacagtagggaaagatttttcactgtgtatatacacattttcttctacctttcaaattttgtaccaagtacaaaaaattccccaaaataataaaattaaagttacaaataagta

SEQ ID NO: 380901 - DNA, 2269 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctggatcacacaaaagttgggaagagaaggatgtcaattagactacatcaaaatctgggcagagggaggacaaagagctgcctaaagaaactggtagctggagcaaactgcagagatcaagatgaccctagtcaacggaaccagcagcccagagcagggtgtaggaagtgtgcccagaatagccagagaacttatttctaagagaattgatcctaaagaagaaatttctaaattgtcaaaaatgtataccaaggaggttcaccagtgttgttgataatcagaaaaaaacgggactcaactgcaatgatgcagagacagtgatggggtaagtagaccaggaaatcggctgtggggaagagggagactggggcatggggacagtagggaaagatttttcactgtgtatatacacattttcttctacctttcaaattttgtaccaagtacaaaaaattccccaaaataataaaattaaagttacaaataagta

SEQ ID NO: 380902 - DNA, 1885 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctggagctggcaaggtcaccaagtctgcccagaaagctcagaaggctaaatgaatattatccctaatacctgcccccccactcttaatcagtggtggaagaacggt

SEQ ID NO: 380903 - DNA, 2816 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacaggttggagtgcaacggtgcgatctcggctcactgcaacctccgcttcccaggttcaagcgattctcctgcctcagcctcctgagtagccgggattacaggcgcccgccaccacacccagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgaccactgctccgggcctcaaatactaaatatttttatgagctaggcacgaaggagagaacactaaacaagatacagcagacacgattgctacccttaccgaccttaacaatttactcaaataataattaattatgattgtgataaaggaggtacaggctgctatgaaaaataagactgtgtactcaatcaagtccagaggtccagaagagccttttgagaaacttaataaaggctcttatatttttgctctatttctttccagtattcttcatacacatgcgttttacatagttgtaatacacattacatagaattttttttttttgagagggagtttcattcttgttgcccaggctggagtgcagtgacgcgatttcagcccaccgcaacctccacctccagggttcaaatgattctcctgcctcagcctcccgagtagctgggattacaggcgcccaccaccacacccagctaattttgtatttttagtagagacggggtttctccatgttggtcaggcagtctcaaactccccacctcaggtgatccacccgcctcggcctcccaaagtgctgggattacaggcatgagccacctcacccagcctacatacaattttaaccctttaaagcttatatataagccaaactcagaaatgaacattaagatctgataaatgtcttaaaatcgctttccaaaaggattgaacacccttacccgatatataaatgagaaaacatttcactgtacagtctcaggcaataattataggaaaaatagctcactgcagttttaatttgcatgattaagactgatcattttttcatgtttctttacgtttatgtattttaattttttctgcacacataatgcttattgtaaaaactccaaacttcacactatttgagagtgctcaaagtgaaagcctcctgtaatctttacacccagagggatctacagttaattatttgttatatattcccccaaacttttttctacacaatattttaacgaaaatggtacagttatacacactttttgaatataatttagtagactttataagtacaaagtcatggcaatctagtgggagaaaaacagcttttttatgtcaatattttaaaactttttcttgaccatttatcagtttgtcttaaaataaaaatttatctcaaatttg

SEQ ID NO: 380904 - DNA, 918 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcagttttccgtagggagctaagtgaatacaccgaaggtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatcgtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgc

SEQ ID NO: 380905 - DNA, 1004 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggtaggaggccataggaggggcgatgggagccggggctttgaaagggatttaagtgctaaccgatctcagtcgccttcttctcgaagttttccgtagggagctaagtgaatacaccgaaggtcttacctctgaacccctcacagcctagggacaggagcggccggcttacctggtgggttgggggacgtcggcagctcgcgtactacgccagcaggattgaggagcagagaaacagttgcagttggttgtattcagtacctgcatttccgttgggaactccacctgtacttgttattctgtggaacttttttttatttgtagaaggagcaagaatattgaccttactatatagcacacgaaacaatctatgctgtatcgtgcctgctcaatccttaaagttaacttctaatgatagtaaaagaccttcctgctgcctttaaaatgcagcttgtgctagtaacatgcatgtgtcaaattgaagaattagacatagatgactagatagaaagtaattttgtaggtaattttagagttcaactccacccagctttcagtgaaggaacctttcaaataatagatttttgcttaccatagagaaaagatcaaatgacaaagcaaatattgaccattaagctggaatatggtgataattgaacagttgtataaatgaagtaattgaattgtacacatacaatgggtgaattttatggcatgtcaaagtatacctcaataaagctatttttttaaattgc

SEQ ID NO: 380906 - DNA, 2770 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctgggtaagtatgccctccacccgccacaggaaacactgaattgcttctccatagctgcaggttagagacctgcttgttcagacactccacctcaacttgccctcctttgcttagtgtcaccattatcttgaatgcctcctaggggccacataagactaatagagctattaggctctgaagccggaatcaaaaatgcaaatctggttatgtgatttgtctacttaaactttgtcaatagctcctaatagccttcatgtgaaaatgtgaccagaagcacgttactaacactggctagagtgcagtaggagagtgtggtaggacaggctgacccctgccctgttactaggaagacagacactcacccagcctttctgaacagcaactctgctaagagcttttaaaatatgcatattctatgacctaaggaatacttagaaaatcaaaattatatacacactggctgggcgcagtggttcacatctgtaatcccagcactttgggaggtcaaggagggtggatcacttgaggccaggagttcgagacaagcctggccaatgtggcaaaaccccgtgtctactaaaaatacaaaaattagccaggcatggtgccgcaggcctgtggtcccagctactcggaaggctgaggcacaaggattgcttgaacccagaaggcggaggctgcagtgagctgagatcgcgccactgcactccagcctgggcgacagagccctgtctccaaaaaaacaacaacaattatacacacaaagattatcattgtattatttataatagcaaaactggaaaaatccagtgatgcagttgtgttttgtaacaaggaagaacgttcacactattaaatttttaaaagcgggttaggaatagcacaatcccatttttgttgaataaatatatacacaagtatataaataaatacatatatatcaaaagatatatatccaaaagataaatactagctggcaaggtaatctttcaacaatgaacatttataattgtaaaggactt

SEQ ID NO: 380907 - DNA, 422 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacaggtaatatatcttttaacaatgtagaaatttattggcaataaatatgcagtgatatactcaaaagacacac

SEQ ID NO: 380908 - DNA, 342 bp, Homo sapiens
cgcaagtacatctcccttctggatctgcccttgtctctgcttcatacgcaggatgtcctcttcgtgctcaacagcaaagaagtggcacaggccaaggtgaggattgtaaattcctggacaccccaactcagatccctgccccagacccctgtctcctcaaagccccacctctgcagaagccctaactgaaggtttttcacagtggttcagcacctgtccctgagaattagggctaggccagctagatcttgggaggcatagatttttcaatgactttagccttttttttctaattataaaaataatatatgctttttctaaaagtaaataacacatgctcat

SEQ ID NO: 380909 - DNA, 2802 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctgggtaagtatgccctccacccgccacaggaaacactgaattgcttctccatagctgcaggttagagacctgcttgttcagacactccacctcaacttgccctcctttgcttagtgtcaccattatcttgaatgcctcctaggggccacataagactaatagagctattaggctctgaagccggaatcaaaaatgcaaatctggttatgtgatttgtctacttaaactttgtcaatagctcctaatagccttcatgtgaaaatgtgaccagaagcacgttactaacactggctagagtgcagtaggagagtgtggtaggacaggctgacccctgccctgttactaggaagacagacactcacccagcctttctgaacagcaactctgctaagagcttttaaaatatgcatattctatgacctaaggaatacttagaaaatcaaaattatatacacactggctgggcgcagtggttcacatctgtaatcccagcactttgggaggtcaaggagggtggatcacttgaggccaggagttcgagacaagcctggccaatgtggcaaaaccccgtgtctactaaaaatacaaaaattagccaggcatggtgccgcaggcctgtggtcccagctactcggaaggctgaggcacaaggattgcttgaacccagaaggcggaggctgcagtgagctgagatcgcgccactgcactccagcctgggcgacagagccctgtctccaaaaaaacaacaacaattatacacacaaagattatcattgtattatttataatagcaaaactggaaaaatccagtgatgcagttgtgttttgtaacaaggaagaacgttcacactattaaatttttaaaagcgggttaggaatagcacaatcccatttttgttgaataaatatatacacaagtatataaataaatacatatatatcaaaagatatatatccaaaagataaatactagctggcaaggtaatctttcaacaatgaacatttataattgtaaaggactt

SEQ ID NO: 380910 - DNA, 2124 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctggatcacacaaaagttgggaagagaaggatgtcaattagactacatcaaaatctgggcagagggaggacaaagagctgcctaaagaaactggtagctggagcaaactgcagagatcaagatgaccctagtcaacggaaccagcagcccaggtcagccacattcaggagcaccaccgaggcacggcagggagagcaaagttgctggccccaatcattcctccttttcagggcaggagaggcagaagctcactctttagacatgttcttgatggtcttgtgctctttcatggccttctcccaatcgctgccattgaattcctcagtgaccatactccgcacaggg

SEQ ID NO: 380911 - DNA, 2698 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgaccactgctccgggcctcaaatactaaatatttttatgagctaggcacgaaggagagaacactaaacaagatacagcagacacgattgctacccttaccgaccttaacaatttactcaaataataattaattatgattgtgataaaggaggtacaggctgctatgaaaaataagactgtgtactcaatcaagtccagaggtccagaagagccttttgagaaacttaataaaggctcttatatttttgctctatttctttccagtattcttcatacacatgcgttttacatagttgtaatacacattacatagaattttttttttttgagagggagtttcattcttgttgcccaggctggagtgcagtgacgcgatttcagcccaccgcaacctccacctccagggttcaaatgattctcctgcctcagcctcccgagtagctgggattacaggcgcccaccaccacacccagctaattttgtatttttagtagagacggggtttctccatgttggtcaggcagtctcaaactccccacctcaggtgatccacccgcctcggcctcccaaagtgctgggattacaggcatgagccacctcacccagcctacatacaattttaaccctttaaagcttatatataagccaaactcagaaatgaacattaagatctgataaatgtcttaaaatcgctttccaaaaggattgaacacccttacccgatatataaatgagaaaacatttcactgtacagtctcaggcaataattataggaaaaatagctcactgcagttttaatttgcatgattaagactgatcattttttcatgtttctttacgtttatgtattttaattttttctgcacacataatgcttattgtaaaaactccaaacttcacactatttgagagtgctcaaagtgaaagcctcctgtaatctttacacccagagggatctacagttaattatttgttatatattcccccaaacttttttctacacaatattttaacgaaaatggtacagttatacacactttttgaatataatttagtagactttataagtacaaagtcatggcaatctagtgggagaaaaacagcttttttatgtcaatattttaaaactttttcttgaccatttatcagtttgtcttaaaataaaaatttatctcaaatttg

SEQ ID NO: 380912 - DNA, 3864 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgagccacagggtagagggaggatgctcaggggaaaatctggctggaggcctcaaggcttatcacttcaccctgtctcctctccatccagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactccacagatgtgacttttacattgtttccaaagcaggttcaccaaaaacacatacacaaaatgcaacagtgtgtgttgaattggttcaatcataattcctttgatttttcttgtatcagaatgtgggtctaggaaaaacttgctctatttaacaggacagctctgattgaagcatccaagtacaggtcactggggtgggcactgttttatacagagacgattacaagaactctgcctcaaagagcttacaatcaaatatgtcagctctcagtctttttggagaagtaggaagtaggaagataaatctgagacttaaaaaaacacaaaacattcaagaacctgatgtcttaaaattgtcctacgaacaaaagctctctgaaagctctggcttggaaactactctcagaatccagctaacgctccagggaagtggcctgagtcagggaagctaagtggtgaagagcacaggctggtagtcctgcgattgaagccagaatgaccagctgtgtaaccaaaggcaaggtgctgaacctttctctgcctcaattctctcatctgcaaaatgggaaataataatgatcccaacctcagagaactgaacaagataatacatgaaggtgcatatcaaagagtctcacatgctctgctgggtaagtatgccctccacccgccacaggaaacactgaattgcttctccatagctgcaggttagagacctgcttgttcagacactccacctcaacttgccctcctttgcttagtgtcaccattatcttgaatgcctcctaggggccacataagactaatagagctattaggctctgaagccggaatcaaaaatgcaaatctggttatgtgatttgtctacttaaactttgtcaatagctcctaatagccttcatgtgaaaatgtgaccagaagcacgttactaacactggctagagtgcagtaggagagtgtggtaggacaggctgacccctgccctgttactaggaagacagacactcacccagcctttctgaacagcaactctgctaagagcttttaaaatatgcatattctatgacctaaggaatacttagaaaatcaaaattatatacacactggctgggcgcagtggttcacatctgtaatcccagcactttgggaggtcaaggagggtggatcacttgaggccaggagttcgagacaagcctggccaatgtggcaaaaccccgtgtctactaaaaatacaaaaattagccaggcatggtgccgcaggcctgtggtcccagctactcggaaggctgaggcacaaggattgcttgaacccagaaggcggaggctgcagtgagctgagatcgcgccactgcactccagcctgggcgacagagccctgtctccaaaaaaacaacaacaattatacacacaaagattatcattgtattatttataatagcaaaactggaaaaatccagtgatgcagttgtgttttgtaacaaggaagaacgttcacactattaaatttttaaaagcgggttaggaatagcacaatcccatttttgttgaataaatatatacacaagtatataaataaatacatatatatcaaaagatatatatccaaaagataaatactagctggcaaggtaatctttcaacaatgaacatttataattgtaaaggactt

SEQ ID NO: 380913 - DNA, 2187 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaaggtaaggcttgttccttttgcaaagggccacaagatactgtccctctgagaaacttatgagggggaaatttgcaaatccacagagagctgccctcagccgagcagaggcagtggttggggaggccgccacactcttcctgactcacctcaaggtacctggcaggttgtatctaccagcaagtgcctgcctgcagggccacctctggatgagtggggaggccaggtttgcccctcaacctgtctagctttttcacagggtggatgttttacacctctggtattcttccagtctgaactcaatcccatcccccaaccaattaggcaggttgtaaatgactgctgggtgcttgatgaaccaatctgcctgagttaggaactcttcctaacccacataaagtatttgaccctacctgaccatttactgcatgacccccatgcttagcctctctggaccagtttctggtctgtcatacctcaccggcgcaatacgaagattcaatgaatgaaaacgtaagtagtttgtgccctttctatgtgggatgactgaaaggagcttaccaagccatgatgactttggaacatgactatagtttgtttgattcttatatcaatcctgtgagacaggcaggtctcacactatcaacaccaatttacagattagaaaactgagactgagagtggttaagggactttgccaagtctgtcaattcttgactgacagagctggaaccaggtctctaaactcccaatacagtaattcctgtctcctttacttcctttggctttgaggtagccagatctcaacctctagcagccaacctttttctggtagggcacaccgcagggtagagggtagccagccaggtcttctatggcccttttactcgttctagctgcaagaatcatgggcacagggcagctttagtgccacagaaacacgtggcaatgctgtggccactgtcctgccctgccctgagccacagggtagagggaggatgctcaggggaaaatctggctggaggcctcaaggcttatcacttcaccctgtctcctctccatccagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcaggtccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctct

SEQ ID NO: 380914 - DNA, 1924 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagattgtcatatctcagactgatgtgtctatcagaggcacagggacctcaacagcacacgccagtgagtcagtcatcagattatagtagcctgggaatggggtgaatacaggcttgaagtggactagtatctatttccaaggaggcccaatctattgggctggagtacggtggcacgatcttggctcactgcaacctctgccacctgggttgaagcaattctccagccttagcctcccaagtagctgggattacaggcgcctgccaccgcgccctgctaattttgtatttttagtagagatagggcttcaccatcttggccaagctggtcttgaactcctgaccttgtgatccacccacggggactcccaaagtgctgggattacaggcgtgagccactgctccgggcctcaaatactaaatatttttatgagctaggcacgaaggagagaacactaaacaagatacagcagacacgattgctacccttaccgaccttaacaatttactcaaataataattaattatgattgtgataaaggaggtacaggctgctatgaaaaataagactgtgtactcaatcaagtccagaggtccagaagagccttttgagaaacttaataaaggctcttatatttttgctctatttctttccagtattcttcatacacatgcgttttacatagttgtaatacacattacatagaattttttttttttgagagggagtttcattcttgttgcccaggctggagtgcagtgacgcgatttcagcccaccgcaacctccacctccagggttcaaatgattctcctgcctcagcctcccgagtagctgggattacaggcgcccaccaccacacccagctaattttgtatttttagtagagacggggtttctccatgttggtcaggcagtctcaaactccccacctcaggtgatccacccgcctcggcctcccaaagtgctgggattacaggcatgagccacctcacccagcctacatacaattttaaccctttaaagcttatatataagccaaactcagaaatgaacattaagatctgataaatgtcttaaaatcgctttccaaaaggattgaacacccttacccgatatataaatgagaaaacatttcactgtacagtctcaggcaataattataggaaaaatagctcactgcagttttaatttgcatgattaagactgatcattttttcatgtttctttacgtttatgtattttaattttttctgcacacataatgcttattgtaaaaactccaaacttcacactatttgagagtgctcaaagtgaaagcctcctgtaatctttacacccagagggatctacagttaattatttgttatatattcccccaaacttttttctacacaatattttaacgaaaatggtacagttatacacactttttgaatataatttagtagactttataagtacaaagtcatggcaatctagtgggagaaaaacagcttttttatgtcaatattttaaaactttttcttgaccatttatcagtttgtcttaaaataaaaatttatctcaaatttg

SEQ ID NO: 380915 - DNA, 260 bp, Homo sapiens
ggtttcgccttgctggccaggctggtcttgaactcctgacctcaagtgatctgcctgcgtcagcctcccaaagggctgggattacaggcatgagccactgcacctggtcccttgaactctttttaatctatactcatttccgtgatctcatccagtctcctgactttcagtaccatctaagatatataatatcatcatatatgatgacaactcttaaatttatatctccagctcggatctcttacctgaactccagattc

SEQ ID NO: 380916 - DNA, 397 bp, Homo sapiens
tccaacaccctgtggaagccaccaaggggtggggcttacaccctctgaagcaatggcctgaactacatcttcaccccttttagccacagctggagctgaagcagttgggacacaggacaccaagtcctgaggatgcacacagcaatagggtctgggcctggcccacaaaatcactcctgacactaaaaactatcagaacagcataatggaaactgttcccatgatcaaaccacctcccatcaagtccctcccttgacacgtggggattagggggattgcaattcaagatgagatttcagtagggacacagagccaaaccatatcattcccccttgctgtttctgtgatagtgagtgagttctcatgagatctggttgtttgaatgtgtgtggcactt

SEQ ID NO: 380917 - DNA, 373 bp, Homo sapiens
ttttttaaaaagcaacattaagctaatatattcttactgcagaaaaggagctttgttctatttatctctaaaactgatgctcactagtagttctcagatttggaaaggtatttgtactatttatttataggagcatttatttataggaaatactggctgggcgtggtggctcatacctataatcccagcactttgggaggccaatgtgggcggatcagtttgagaccagcctggccaacatggcaaaaccccgtctctactaaaaatacaaaaattagctgggcgtggtggtgagtgcctgtaatcccagctactccggaggctgaggctggagaatcgcctgaacctgggaggcggaggttgcagtgggccg

SEQ ID NO: 380918 - DNA, 443 bp, Homo sapiens
gggagactgtctcaaaaaaaaaaaagaaattcagaggtgctacaatgtggatgaacctagaagacgttatgccaagtgaaatacgacaaccacaaaaagacaaatactttgtggtttcactcacgctgggtacctataggagtcacttccacagagacagaaagtagaatggtggttgccagaggcagggattgggagttagtgtttagtggatatatgggttacagagtttgttttacaaggtgaaagcgttctgaaacgcccagttgtggtggctcatctgtagtcccagcactttgggagactgaggcaggaatattgcttgagcccaggagtttgagaccagcctgagcaacatagcaagaccccatctttaaagaaaataaatacataaattaaaaagttctggagctagatagtgattgcatagtagcgtgaatgca

SEQ ID NO: 380919 - DNA, 2621 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380920 - DNA, 1323 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380921 - DNA, 1007 bp, Homo sapiens
tgttaggcaccccaatcccctcttccctagccctggctttcagggcaccatagagctgggtgaaagaaagctatagcaagagaggcatcccttcagacctcgtggggccaggtttgcccaccggagcaaacgttttgaaggttaagaaggtggcaccatcttccggagtccccacttggttcctgcctctgcctctgtccctgcagcaccttcaggtcttacccgctcctcttcccaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380922 - DNA, 914 bp, Homo sapiens
ccacgcgtcgcccacgcgtcggtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacagtccctatccggcgtctgtccatgatgtgacaaacatttttcttaccctcgggaaccaggtcttcctggcaagttggatctctgataaatcggcgccccagccaaagcgggcctgggggccctgagtcggggcaaaccggtgggcgggggagaaaagggtttggggggccctccctgggagggtgtgtctgggccccgctgggttgggggaaccctaaaaacttcctggcagatcttcggggtccacttcgg

SEQ ID NO: 380923 - DNA, 2749 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaaaaaaaaaaaggcgggccctaaagttccccagggcagttccgtcccgttttggtccagggccctatgagcgttaaaccagcgggcggtaaacggtgcggacaggctcggcttgggggcaccttggggaa

SEQ ID NO: 380924 - DNA, 1915 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacagttgaagaagctggatctggcagctgcggcagcacacaccttctttgtagcaaaccccatgcacctgcagatgcgggaggacatggctaagtacagacgaatgtcgggagttcgg

SEQ ID NO: 380925 - DNA, 2480 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaatcagcttccatcacccctagcaatatgtattaaagtctgaagtgttgccatggaaa

SEQ ID NO: 380926 - DNA, 2376 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactgggcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380927 - DNA, 341 bp, Homo sapiens
aatgggaactaaaggggtctctgggagcttataaaggcagtggtgggaggccgcggtaggcattccctacctgtaaccactctgcccattttctctcctagatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtatggaactgggggatacatctcctacccttggtgccgctcatcacttttctccagtgtctgttaggcaccccaatcccct

SEQ ID NO: 380928 - DNA, 1619 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380929 - DNA, 1191 bp, Homo sapiens
tccgtcatctctcctccagttccatcatccatcttcctctcctctgtccatcccccactccatttgtggcccccatcttgatcatctgtcttttagttcccactaccctgtttaccccagctccagcatctgcttcagttcccactcctcagctccatcaccgtccttcagttccacgacctgtcctccagctccgtcatccatcctgcagctccacggttcagccgcagacctctcatccagccgctgggctccactctccattccctccttccctctggctgccacatggtctctgagcactcttggctggaaatcccacagggctcaccccaccaccccatctagtcactgttcctgggttcctgtctgtctctacggttcctggtccacctctgttcctctccctcctgaccgcaggctttgtctccagcactctccccgaccttcctctgagtcagtcccttccctctgttcactccatctccacctccggcttcgcctctgttggagcacagggatcaggcattacttctgacgtcttgcccaccagctgcactaggatatggggttcaggtgggctcctcagctctggccctgacccagcccgctcccacccttccccaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacggtcagaggaggggctgggctttggctttcctggacatctgtctattcccttttctgccgctccttctcagccagaggatgggctgccctggagtgccccctactggacagaatctgcaccaccctgggctcccctttccctaagcaggcaccctgctgtccactcactgcttcccgcagcactcagggctcccttcactgggcctaggctcccctccagaaacccacactgcccagctctggcactatggggaacctgagcttcccgagagaggccccccagctatagggacggctcttgggggagtgcaggcaattgtttcaataacttcatctatatgtatgaagcactccactcaggatttagcactgaac

SEQ ID NO: 380930 - DNA, 2570 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380931 - DNA, 2650 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaaaaacaaaacaaaacaaaaacaaaaattag

SEQ ID NO: 380932 - DNA, 2068 bp, Homo sapiens
ggcacgaggcagagaccgagtgagccgtgggctgagcctgggaggccgggactgagggggaggagggaggcccgggggaagggagggagggagagagggaaggagggaggagggcgggcgagctggagccggcaggcagcgggagcccgagagagccgcgtcgggagtgcggtctccatggcagtgctgggcgcagccggagagagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacggtcagaggaggggctgggctttggctttcctggacatctgtctattcccttttctgccgctccttctcagccagaggatgggctgccctggagtgccccctactggacagaatctgcaccaccctgggctcccctttccctaagcaggcaccctgctgtccactcactgcttcccgcagcactcagggctcccttcactgggcctaggctcccctccagaaacccacactgcccagctctggcactatggggaacctgagcttcccgagagaggccccccagctatagggacggctcttgggggagtgcaggcaattgtttcaataacttcatctatatgtatgaagcactccactcaggatttagcactgaac

SEQ ID NO: 380933 - DNA, 1744 bp, Homo sapiens
tccgtcatctctcctccagttccatcatccatcttcctctcctctgtccatcccccactccatttgtggcccccatcttgatcatctgtcttttagttcccactaccctgtttaccccagctccagcatctgcttcagttcccactcctcagctccatcaccgtccttcagttccacgacctgtcctccagctccgtcatccatcctgcagctccacggttcagccgcagacctctcatccagccgctgggctccactctccattccctccttccctctggctgccacatggtctctgagcactcttggctggaaatcccacagggctcaccccaccaccccatctagtcactgttcctgggttcctgtctgtctctacggttcctggtccacctctgttcctctccctcctgaccgcaggctttgtctccagcactctccccgaccttcctctgagtcagtcccttccctctgttcactccatctccacctccggcttcgcctctgttggagcacagggatcaggcattacttctgacgtcttgcccaccagctgcactaggatatggggttcaggtgggctcctcagctctggccctgacccagcccgctcccacccttccccaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacgatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaa

SEQ ID NO: 380934 - DNA, 494 bp, Homo sapiens
agaccaaatacacctttaggcaacagccattaacatataaaaggaggaaaagataatcagtttctagtcatgtttcttatatctgctgcattagagaaaacagctgagttattcaatctcaccatgaattaaaacattagcaaagtgagttttttggtgtgagttctcagtttttcaatagcaagatggtgataatggcttattgggggacctctgaaatggaaaaagtagagaataagagtaggaagttgtgttaaggctgtttttacatctcttctttctgttttaagtttgctgggccagaaaaactaagttttataatagctcaaaatatgttaaatcaggcactggctcaggagacagataattggagtatgtaggtaatatgggaaaccagagagcacctgccctatttgcaggcatgaaattcaatttatactaccacaacaacactaagcaccaatcccgacatgtctagaggcaccaatttgggt

SEQ ID NO: 380935 - DNA, 421 bp, Homo sapiens
taattttgagatggagtttcactcttgtcacccaggctggagtgcaatggcgcaatcttggctcactgcaacctccacctcccgggttcaagcaattctcctgcctcagcctcccaagaagctggcacccaccaccacgcccagctggcccgattgatttttaatagttaaaccaactttgcattcttggaataagttcatcctggccataacatatttatcgtttttaaatattactggattgagctggcaaatattttaagatctttgcatttgtgttcatgtgtaaaattggccaaatccttgtcacatttgtgtatcaagattatgctgatttctggccaggcgtggtggatcacgcctgtaattccagcactttgggaggccgagggggtcggattatgaggtcaggagatggaga

SEQ ID NO: 380936 - DNA, 370 bp, Homo sapiens
aaacgttttcaccacaaagaaataaatatttgaggtgatggttaagctaattggcctgatttgatcattccgtgatgtaaacatgtatccaagtatccaaaccatcacattgtacctcatgaatatatacaattattatttgtaaattaaaaataaagtaaaactcaaaaaaagacaaagagagctctcaagcagaggaatagaaaacacagctaagagtgtgacacttgggtaggctgaggggctataggtgaggcactgacaacacctgctgccttgtccttggtattaaagggtgttcatgtcaacctggaagaaggtggtgaggttaggatggaaggtgtggccctacatttgcacctggtggaca

SEQ ID NO: 380937 - DNA, 565 bp, Homo sapiens
cagcgatagagattcaggaagtgaaagatggaaataaaagccagaaagtagtagtaggagtggtaacagaagtggtactagaacgtaagagttccagaggggatgtgtaagagcatagtcctgcaattacataaaggattgagagcaaacccagtcctctgtaattttagtccattattccattaacagagttttaatgatgattctaccaaatataataaattaaaaaccagtggaaatatctgaaatcctgcagagcctccacgtgtggtcgtgcagtgtgtgcactgcacagagtgacccagccaagggcacaggagatggaggcagaaatcctccaagtcttaccactctgcaactgcatctccatgcaggaggactcccttttctaatttgaatacaactttctcataggctattggaagccctgcgaatggaaggagaggaactagagtcagtatagaaaagtttttagaaataaggctgagggtgaagagtgatgtgtccataagggtgtgagaagtctgtcttttaaggtaagagctacttgggcatctatggaaaa

SEQ ID NO: 380938 - DNA, 362 bp, Homo sapiens
cataataaaatactagaaaaaatgagatattttctccctcatcttttcccggttcacattccaattcttgatgaaaatattgacattctttatagttcttaccaatgaacatttaaaaaatggctacatccaagggtgaaacaaatgcgttttcatcaatagagaaacatatgttcagcccttaggtagtgcctgtggaaaacatttaatattgcggggcttcttgtcatttctcaatagttgtcagattgtcaactccacatcccaggtgctcagcaaactgtaatttccagagctctctggcagagggcatatagatctatccagctgacctcacgtaaatattgtagaaatctgtcttc

SEQ ID NO: 380939 - DNA, 185 bp, Homo sapiens
gaacaccccgcttcacaggagcttagagaagggtgaaaagataaggcacattcagcagagaagcacccaaggaggcagtgtggtactgaggccctgctgctaagcactggcatttggacagctagacaggaagaaagggctctgctgtgccataggcctgtggggtgactacagttaacagtact

SEQ ID NO: 380940 - DNA, 293 bp, Homo sapiens
ctatttttgtatttccacttaggattctgagagaacattaaaagtgtatttctgtacatttcagatcgatcccttgaaaacgtacattcaccagaggtcctaactaaaataagtagataggtgagtttgaaaatgaatgttgatatcttcagagatacagaaaccttggtaacatacacaataaaggtcttagacaataggaacaagtcaaatggtaataaaaccaatacatgaatgagtaaagatatgtgagaaaaattagcctacgtaatacactataaggctaaaagaat

SEQ ID NO: 380941 - DNA, 2688 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaataccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctccttcatgcgtcatcgtgccacttagctgagccagccagctctgcctccctccccaaagacctttggaccccagttcccctctacaggctagctcatccctctgggtggtcattccccgggtcacgttgagagcgaggctgactgcaccacctccctagctcaagggctcctttgggaggggccgcgtgctttatcatcctcctgccacaactcaaatagtggttatttacaagaaggtctgttcccacaaatcaggaccctaaagtattaaaaaacaaaacccaaaaaacaacaaaaaaccccacacaaccaaaagtttgacgtgaatagaaagatagcccttctgcatggtagtcaacaaataccagcactagaaaatcaattgctttaattgcattgcagcagggagcctcagcaccatgtggggaggaggaaatgggaaggtcttggtttcagagtgcttttggctggccagagggtggccaaacagggcaagggggctccctctgcttgggcattgtccacccctggtcagtgagaggggggcagcaggggtgctccccacggcagtcctgctgcggccttccctcctggcctattcctggggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtgcagatccttcctgtgtcactccaggcccagaggaactgagaagccacctgctgttccggcccttgggctgtttgggaaaagccagcagtcagagtgccagcctcaagctctgattatccccctcctgtggccctggtagttcaagcaggtcctggcagcaggagggctgtgccatggaggatggatacgactgcactcatactcaaaa

SEQ ID NO: 380942 - DNA, 356 bp, Homo sapiens
aatttccagaaaaaaagggtaagcttttgttgtggaaattgaagccttcagttataagagtatggacatttattttaataagtatttgtcaagtattttgtttcggtgtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380943 - DNA, 2828 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctccttcatgcgtcatcgtgccacttagctgagccagccagctctgcctccctccccaaagacctttggaccccagttcccctctacaggctagctcatccctctgggtggtcattccccgggtcacgttgagagcgaggctgactgcaccacctccctagctcaagggctcctttgggaggggccgcgtgctttatcatcctcctgccacaactcaaatagtggttatttacaagaaggtctgttcccacaaatcaggaccctaaagtattaaaaaacaaaacccaaaaaacaacaaaaaaccccacacaaccaaaagtttgacgtgaatagaaagatagcccttctgcatggtagtcaacaaataccagcactagaaaatcaattgctttaattgcattgcagcagggagcctcagcaccatgtggggaggaggaaatgggaaggtcttggtttcagagtgcttttggctggccagagggtggccaaacagggcaagggggctccctctgcttgggcattgtccacccctggtcagtgagaggggggcagcaggggtgctccccacggcagtcctgctgcggccttccctcctggcctattcctggggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtgcagatccttcctgtgtcactccaggcccagaggaactgagaagccacctgctgttccggcccttgggctgtttgggaaaagccagcagtcagagtgccagcctcaagctctgattatccccctcctgtggccctggtagttcaagcaggtcctggcagcaggagggctgtgccatggaggatggatacgactgcactcatactcaaaa

SEQ ID NO: 380944 - DNA, 1785 bp, Homo sapiens
  misc_feature (16)..(16): n is a, c, g, or t
  misc_feature (27)..(27): n is a, c, g, or t
aaattaggctaggtangaggctggtgntgcgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380945 - DNA, 2490 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctccttcatgcgtcatcgtgccacttagctgagccagccagctctgcctccctccccaaagacctttggaccccagttcccctctacaggctagctcatccctctgggtggtcattccccgggtcacgttgagagcgaggctgactgcaccacctccctagctcaagggctcctttgggaggggccgcgtgctttatcatcctcctgccacaactcaaatagtggttatttacaagaaggtctgttcccacaaatcaggaccctaaagtattaaaaaacaaaacccaaaaaacaacaaaaaaccccacacaaccaaaagtttgacgtgaatagaaagatagcccttctgcatggtagtcaacaaataccagcactagaaaatcaattgctttaattgcattgcagcagggagcctcagcaccatgtggggaggaggaaatgggaaggtcttggtttcagagtgcttttggctggccagagggtggccaaacagggcaagggggctccctctgcttgggcattgtccacccctggtcagtgagaggggggcagcaggggtgctccccacggcagtcctgctgcggccttccctcctggcctattcctggggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtgcagatccttcctgtgtcactccaggcccagaggaactgagaagccacctgctgttccggcccttgggctgtttgggaaaagccagcagtcagagtgccagcctcaagctctgattatccccctcctgtggccctggtagttcaagcaggtcctggcagcaggagggctgtgccatggaggatggatacgactgcactcatactcaaaa

SEQ ID NO: 380946 - DNA, 1766 bp, Homo sapiens
  misc_feature (16)..(16): n is a, c, g, or t
  misc_feature (27)..(27): n is a, c, g, or t
aaattaggctaggtangaggctggtgntgcgcggagcagacgcggaggctggtggcccctgggcgagatgccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380947 - DNA, 1881 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggctctctaggaacttgggtgccccaaaaggagcagtggcaaccttgtgctgacctgtgtttgacctcaggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380948 - DNA, 2199 bp, Homo sapiens
gtctcgctccctcctagtctctctctgttcggcgccactgcgacttgactgagatgatgttgttgctggttcgctgtccagctcatccgcctccattcgaccccatctctcgccctagccgtctgtcgtcgttggcgcgttaggttcaactttgcatgtgtctagtctctttgccctgtctctgtctgtctggactctcgcttcatcagggatgtgtcgttatgttgtaataccgagacctcggtcctgagtccgttgtgtgctctcttatctcagttcttttcttatcttggtctgcagttctgctgatgtgggcctgttctaacctgtaccgtggttcgtggcgagctgtgtctctcatagtccgcagtagctcttgtagttcggggtcggttgttgtctcacgtgctgcattactggcctggccgcgtggttggttatgtggtatgctggtctcctctgcccgtttcgcttgttgcgttgccttctgcacgttcttttttgatctgtctcgagtgcaacccagccttggcacctcgtcacggtgtgtcttcatgctgatgtagctctgcagccgttgtcctgccaggagatgcagtcaatttcgcacgtggtagcctcacgatgctcctcggctgcctgacggattccagtggtactagcatttaggtgagggggctctatttatggcttacgggttccggtgttaccagggcgtggcagtacatagcggcaatacatgtcgagtgtgttcctgtaagtctgacaaagtaactttttggttaatagcatttagagtcctgtggcttgtcaccgtcgcgcatccatatatcacatgatagtgtcactctcgttccgacgcagtcagtgacaccccttcagcctccaatcacctgctgactttacggttgttggggctgcgccgccggtccggctggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctccttcatgcgtcatcgtgccacttagctgagccagccagctctgcctccctccccaaagacctttggaccccagttcccctctacaggctagctcatccctctgggtggtcattccccgggtcacgttgagagcgaggctgactgcaccacctccctagctcaagggctcctttgggaggggccgcgtgctttatcatcctcctgccacaactcaaatagtggttatttacaagaaggtctgttcccacaaatcaggaccctaaagtattaaaaaacaaaacccaaaaaacaacaaaaaaccccacacaaccaaaagtttgacgtgaatagaaagatagcccttctgcatggtagtcaacaaataccagcactagaaaatcaattgctttaattgcattgcagcagggagcctcagcaccatgtggggaggaggaaatgggaaggtcttggtttcagagtgcttttggctggccagagggtggccaaacagggcaagggggctccctctgcttgggcattgtccacccctggtcagtgagaggggggcagcaggggtgctccccacggcagtcctgctgcggccttccctcctggcctattcctggggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtgcagatccttcctgtgtcactccaggcccagaggaactgagaagccacctgctgttccggcccttgggctgtttgggaaaagccagcagtcagagtgccagcctcaagctctgattatccccctcctgtggccctggtagttcaagcaggtcctggcagcaggagggctgtgccatggaggatggatacgactgcactcatactcaaaa

SEQ ID NO: 380949 - DNA, 1812 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380950 - DNA, 1915 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgttctccagataggaacatgcacaaagcagttaattaggcagcctggagaaaaccagagatccagtacagaaaggaaaggatatttattgattaacagaagttgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380951 - DNA, 1758 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcatcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380952 - DNA, 1742 bp, Homo sapiens
  misc_feature (1486)..(1486): n is a, c, g, or t
  misc_feature (1500)..(1500): n is a, c, g, or t
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaaaagtacaaaatcaggatgtntttcactgtccatngctttgtggtttaataaacaatttgcagtgaccaacacaccacacacaccacaacaaccacaaacagacaaaacaaagaatacaaacaaaggggcggcgagccaaaaaaacacaggggggagcacatggaccccctggagaaagagggcccaaagggagataaaaagagagcgacgggggctcaaacaaacgggggagcacccaggcgctatgaaacaccctggggagaacaggccacacgg

SEQ ID NO: 380953 - DNA, 1474 bp, Homo sapiens
agcggggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagtccttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctc

SEQ ID NO: 380954 - DNA, 2114 bp, Homo sapiens
tccctctttccttctctctgcgtggtgctcgcgtgcgcgtcctgacgctgtctagttggcgcgcctgtgctcctccggccctctgggctgtgcctgctccccttctctccttcccttccgtgctggcctccgctgtttctcgcccccctcttgtcggctctctggtccttcttctcgtccgtcttggtcgctcggctctctcccgctctgcccctggccccctgccccccctcccctctcggcgctgctcctcccggcctccgccaccctctcccctccctcttcgctcgtccgcgctcgtcgctgtgcctgcttcgtcgtgccgtctggccgcgtcgcctcgtgtttctctcggctttccgtgcgtctctccgcggtccgtctcttggcctgtccgcttgcttcgctcctctctctctcttcttctcttgtcgtcgcctctcgcgtccgctgccgctgccttccctggctctctcctccccccgtcgctggggccgttcgctgctgcttccgctggctctcgctctcgtcgtctcggtcgctctcggggcgacacgcccccctcccgcctgtgccgcccgggcgggggcgcttctctgcgacttcgcgcccgctgtgcggccgggcgtcgctcgcccggcggtcgccccggccgtcctgtcttcgcgccgccgtcgaggcgcgctcgctgcctctcgctcgctcgggccccgccgccccgtggcatgtcctgctggcgtctccgtccgcgcgagcgcccgaccgcttcgctctccggtcgtggtccgcgtcgctccggcttcgttctcgtcgcttctgactcgcctcctgttcttacctttctttctgctggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctccttcatgcgtcatcgtgccacttagctgagccagccagctctgcctccctccccaaagacctttggaccccagttcccctctacaggctagctcatccctctgggtggtcattccccgggtcacgttgagagcgaggctgactgcaccacctccctagctcaagggctcctttgggaggggccgcgtgctttatcatcctcctgccacaactcaaatagtggttatttacaagaaggtctgttcccacaaatcaggaccctaaagtattaaaaaacaaaacccaaaaaacaacaaaaaaccccacacaaccaaaagtttgacgtgaatagaaagatagcccttctgcatggtagtcaacaaataccagcactagaaaatcaattgctttaattgcattgcagcagggagcctcagcaccatgtggggaggaggaaatgggaaggtcttggtttcagagtgcttttggctggccagagggtggccaaacagggcaagggggctccctctgcttgggcattgtccacccctggtcagtgagaggggggcagcaggggtgctccccacggcagtcctgctgcggccttccctcctggcctattcctggggcaggaacaagctccagccttcctccacatggctgaggtaatcagcacccctaccccaggggcatcttcccagcctacaaagcaggaaggagcctgtgcagaagttacattttaaaaccagattttcacctgaggcgtcaaccagatgtcacctctgcttaaaactccaactgcaaggctggcaagcagcacagaggaagtgcagatccttcctgtgtcactccaggcccagaggaactgagaagccacctgctgttccggcccttgggctgtttgggaaaagccagcagtcagagtgccagcctcaagctctgattatccccctcctgtggccctggtagttcaagcaggtcctggcagcaggagggctgtgccatggaggatggatacgactgcactcatactcaaaa

SEQ ID NO: 380955 - DNA, 410 bp, Homo sapiens
cacattttccctgattattttaccctctgttgtgatttaattatgtcctttcagttacgtacttttaaggaaaatgaaggatgtatacaaaagctacagaggaagaaatagcggtgatggttttatttctcatcaccatagtctaagttacaaaggttttttgtttgttttgttgggggggtttgttgtttttttgtttgtttgtttagacaggtctcgctcatcacccaggctggagtacagctcactgcagcttcaacttcctgggcacaagtgatcctcccacctcagcctcccaagtagctggaaccacaggcttacaccaccacacccagctaatttttaaattttttgtagagacaaggtctcgctgtgttgcccagactggtctcaaactcctggactcaagc

SEQ ID NO: 380956 - DNA, 282 bp, Homo sapiens
gccagtataaatagagtagctagagatgagtctgaagagttagctagggagtaggttatgaagaatctgaaatccgtgctaaggcttgtgaattcagaaatagtagagagccaatagaaccttttaaacaaatgaagaatatcggtatttaggaccatacttgatgacagtgtggtgaatgagagatgagaaagacttgagtcctggagaacatttggaaggctgttgtagtagtctaggttagcggtcttcaaaccattgatcacacgtccccattaatta

SEQ ID NO: 380957 - DNA, 556 bp, Homo sapiens
ttttcagacggagtctcgctctgccacccagactggagtgccttttcccctcatcgtgtgggagccgccgggcgacatcccgccccggtttccctccactcgaaggcagtcacctcggttgccagctcctgcctctgtgatgatccccacgagggctgcagagtgaagggcacagcggggttcggcctaactccccggggagccctaggcgagagggcttggtcctggggagctgcccaggtcttctatatcccctggcctccatccagtcccgcacgactcagctcctggccctgtgcaccgggcgacgcctgctaggcgcatgaccctcagagtcaggcctgtactcacctcagcatctatcaagggccttcaaggatcgggtttttttaatcatcgtcaaatatatcgttactaaaaagatacgtacactttgggaggccgaggtgggaagatcacttgaggtcaggagtttgagaccatcctggacaacatggtgtaaccccggtctcttctaaaaatacaaaaattatccgggcatggtggcggacgcctg

SEQ ID NO: 380958 - DNA, 751 bp, Homo sapiens
tcagttcaagtctgggttttctttgctagctgtggtaatccagcacaagttacttaactactcagaccacagacatagcaataacgaccttgagaggttgtgaataaccttggtgcccagtgaaggtctacttccctctaccacgtgcagcattctcaagaaaccattgcttggggtttttctgcagcctctgttgccaaacttggacaggaagaggtgggacggagagatagcagaggggcctgagggggctaccctggcatatgcagctgcaggcacccgcagactgacctcttaacatcccagtttatacttagcaaggattaggtgacatgaagacgatcctggcttgatgggtcatgaggctctgaaggaaaagtgggagaaaataagaggtaaacgagcctagcctacagcctcccagaggccagccctgacccagcacagctgggagccccgtgaggaaggcccggctccgtaggggcctcacacaaggagtgtttggcttacagtgaattgtccggggggttttgcccacctcctcctcatctccgtattcttcagcttcatccaaaactgacttagaagcctcccttgaccctcacctgactattcacaggttatagcactttatgtttttcagttctgttattttaattggtgcctctgtttgtgatctttaagaacataaaattctggcaagtaactatttgctaacaataaaaataatctttttaaattaaaaaaaatt

SEQ ID NO: 380959 - DNA, 314 bp, Homo sapiens
atcgactgacacttttgtaaaatataaaatctcatgacgggccacagccacgtcagactgcttgaagagcttctgaacacggcctgtcactttctgtgagtagcctgtgggctgaccgtggcccggggaggccacaggaatgcactgtgctgtgaacgtgccatgctgtctcagcactgcttgagacagtgggagggatttctgaaatgtggtttgggtgcccagtctccagggaaacaggcaaagcacctggtgacaatgtacatgtgatgaggaccacatgggggaagaaacgtgtggcaggggcgggggct

SEQ ID NO: 380960 - DNA, 868 bp, Homo sapiens
ggaagaggatgacgaagaagtccagggcaagccttttcagttatacgcatcactttaacttccacttacattgtattggccaaaactgagtcatgtggacacagctagctaaagatagtccctaactaggcagccatgtagccagtgaatacagagaggtagagagggaattgggtctgttattaaaaggaagaaaaggagtgtgattcctgctgacagtttaggagtcttcaccacaaaaggattccagactctcaggctggaacctccctgccactttgttcatgcctgcaacaggctttattttttcacaaattgcaaaatattgagaaagtaggttagtttatgtacatgtggcacaaataaacttgaagggtaagaccaacagaatttggaaaattcaaattaaaaaaagtaaaatctgctactttagtgatggtttcaggctatatatattttttttgacaaagagatgaatagcttaaaacaatgctcactatctcaacagtttgcgggtatgtatgttttgtaatgcattagccttaatgcaggctttggtagaaggaattaaatatagttaagtttcacgttgaaaataaacctccctcttgccctactgctagcattggaaaggggaacaggagccaggggcaatgaggggtgggcagggtaagcttccttcttgctccgggcaaggcttttagtggaaatgtatagaaggagccaaaattagggagcaatgttttggaggcaaaagccagcctttcccagcatctctgaaaggagcttatcttaacttattgcaacactgaatgatatgcttgaatgttatttgtacgaataaagatatttgcatcatgtcaatacc

SEQ ID NO: 380961 - DNA, 483 bp, Homo sapiens
gaacacgcaacatcctgaggtcaacagtgacccttagaagaagggctgggaaagcacatcctccactgctctcgactgcagccaccgtgagccggagccaccgctgcacccagctaggatacccgtgccttgagccaagaaaacctagcagaaaaatggaggcagccttgggaaatacttgaaaggggaagagggtaaaaaaaagtaaagaagggccgggtgcggtggcttacacctcagcactttcagaggctgaggcaggaggattgcttgagcctaggagttcaagaccagcctgggcaacatagggagaccctgtctctacaaaaaattttaaaaattagccaggcgtggtggcgcacctgtagtcccagctacttgggagacagatgggaggattacgtgagcccaggaggctgtagtgagctgtgatcatgccgtgcactccagactgggcaatagagcaagaccctgtctcaaacc

SEQ ID NO: 380962 - DNA, 505 bp, Homo sapiens
tatgaaatgtcttaggaaactcttctaggacatagactgagatagcaaattatctatttttaaaatttgtcataatcctgatgttacaacctactagaacccaaaacaatttgtccagaatcagttatgaaaatacagcattataaattagcaaatcaaatctagtaacccattgaaaataaatatttgtcacattctgaatttaggaaaaaacaattctgataaatcaaactttctactttctgaaacttgaaaatcaaattgatttagataagattgtatttcttagtgtctgaactcaggaaccaaatagatgtggatagcatgggatttttggaatacaagataagataatttacatgggattgcaaaagttcaaataactaaagttctgtcaatgaaaatatatgctctaacctcaacatcttctagatgaacccttttttctagcagtatttgacaggatgggatatattttataaataaacttggactattatcctat

SEQ ID NO: 380963 - DNA, 318 bp, Homo sapiens
aaatgtgcacaacttgccaactcttggccttcactgcctagtctaatggaagtttgtggccaaactgagaccacaaactgagaaaaggttgctgaggtgtgggccagcatatcctgctgaggactaattcaggactgcaaaatcaggagaaacctggagagagtacataaggctggagcagaagtagatctgaaggagagccacactgcggcacaggtgcagaggcatgaagagggctgagggcagcgagggaatgctaagaaaagccttcagaggaaatctggacacagctctccaaggctacggaaagggaaacaa

SEQ ID NO: 380964 - DNA, 478 bp, Homo sapiens
acttccccttcctgccaaaccctggcaatcatcattcttctgtctctatcagtttgacttatctatatacctcttataagtggaggcgtacagtatttgatcttttgtgactggcatatttcactgagcataatgtctttaaagttcatccatgttgtatcatgtgtcagaattctacctttctgaggcagaataagaattcattgtatgtatttacgggctgagtatacctaatccaaaaattcaatatctgaaatgctccaaaaatctgaaactttctgggcactgacattgtactcaaaagaaattctcattggagcatttcaggttttggaattttggattttcggatgagtgatgcaaaagtggtgtaatgtaaatgttgaatatttcaaaatccaaaaaatttcaaatccaaagcacttctgtcccaagcatttcagataaggaatatttaacctgtaccacgttaaaaaaa

SEQ ID NO: 380965 - DNA, 299 bp, Homo sapiens
cacccgtcttggcctcccaaagtgctgggattacaggcgtgagccaccgcacccagccaattgaagttttccacatgtactcattcaattagtcccactcaaagaatctacgttaaaactgccattaaagataagagaaacaaaatgtaggtcactcagttcaaaacatgtttattaaaaattgggatatatattccccctaggaaagaaggtataattggaagtttacaaacaaatgactttgccagttacagtaggtaagagtattctaggcagaggaataaatctgttaggaaaaa

SEQ ID NO: 380966 - DNA, 861 bp, Homo sapiens
tttagtacagccacataatgtgccatctattgttcattcacaggtttataggtccagcaaggttgagaaattgccacccttgtataaaacattgactttttctgggtcatctcagactataactcctgaaaatcagacgcttaattattcatctaatcagcaagaggtattgtcttcagttacaaatgagaattaccctgctcaaacaagagatctgtcttcagtaagtcagtctcaaagttactcatctggtcactctcagggtttatcaccagttagccagacacaggttagctattcatctcaatcacaagttttgtcagttgttagtctttcagaaagctatgcttcaggggagtccctaacattaacagccccttctctttcttattcttctgcctctcgggctcagaatttgccagactctagcccgacccagaattatatttctatgcattcttcccaaaatgttcagactcaagagtcatcatctccccagtcccagaagtttttgcctgctgtccagtcatcatcttttgcatcctctactcattgtcagacattacaaaataacataacttcccctgacccaaagtcttatgctgaaagaaagcttgactcagatgtgtatccatcttcaaagcaagaagatggttttccaatgcaagagttacaggtgttgcagccacaagcatctcttgagtcatcaacccaaaggctatctgatggagaaattaatgctcaagaatcaacttataaggtgtcaaaggcagatgacagatattctcagagtgtaatcagaagtaattcccgtcttgaagatcaagttattggggttgctctgcaagcatcaaaaaaaaa

SEQ ID NO: 380967 - DNA, 486 bp, Homo sapiens
acaaagtattcaactagttttctagaaagaactactattttttaccttcatattttattagtttgtataatatttaaaaataaattattaataagatctgacattagaaggtctggaataacttgactggtgagagaaaaagtgggtgaatatacgaaagtggcttactcctctagccttcgcatgtcaagggcattggcatttgttatagaaagaatacagaacatcagttaatccaatgaatcaggtatgtggcattaaaagagcttctaatatgatacataaggcttgttaattatatttttcaaattcttgatattttttctcttcttaatctcttaattctgagagagatgattttacttcctcatttttctctgagtatgtctgtcagtttttgccttgtgtaactccaagctatgctagttgcaaaaagaatgataacatttcttcatcatgtactataaactttatcaatgtaaatac

SEQ ID NO: 380968 - DNA, 407 bp, Homo sapiens
tgagaatagtcaatgaagtatagtatttagcacagcgtattttcttccctagtgagaaaggagagatccgtggaatcaaacagaccttccagcgataacctttccacgttgagcctattgattctctgtccgagtgaaattacctgccaggggagaacaagacaagtctttgcatgaaatgctcttgtggaagctagattgccaaataagaaagaatcaaatggtagaaacatgcactgaagtttgaagagatactcagtgcacaaagtagactgtgaaagcctttggggaaatcatgcaatccccgagagactaattgatgacaatccccaaatttatgtttgccagaaaagagagacggtcatgacactgcatagtgagcggtttcggacgtgcgacggcagttt

SEQ ID NO: 380969 - DNA, 388 bp, Homo sapiens
tgtggtagacactgtgatgcactactcagttgcaccttcaataaaggacttaactgcctcagcccttgggagtgctctcagcagacatccttcagctgtcagtcccatcagagattgcctcagccactttggtgcccatactcaaagaacagtgtggtagattaaaggccaagccatctagacccaacttggaacaactctgaagggccattttgggttctgagctccccaggggttatgcaagtctgtaatgggacctgcatgtcaccttaatttctctctctgttcattcttgcctcattcccctcccttcttcagatgttgattgtaacgacacaccttaatatcctgcatgctaaacgttgtcttagagtctttcctagggaac

SEQ ID NO: 380970 - DNA, 448 bp, Homo sapiens
gcccgcttggcctcccaaagtgctgagattacaggcataagccaccatacctggccagaaaccatgattttaacgagcatatggccctgccccgaagaactgtggacatacaggtgagaggcaggcaccccacgctgctgggaaaaatcacagaaagcttcccagaggaggtgatgacagaggtgaaataaatatggatctgtcagcctgtacaagagtcagaggccatgagagagtatggaagaaggagagagatctctcactggaaggtaaagtactaggctgggaatagtggcagatgggaccagagatgtaagcaaagaccacaccacagtgagccttgaatgccaagtacatcagttatgggtcttagctgcaagcaacagaatctactctggtcagtctacatagcaaaaaaataaataaataaaataaaaataaaactgga

SEQ ID NO: 380971 - DNA, 338 bp, Homo sapiens
agtcgacggagactctctaggttcgaggagactctctagttcgacggagactctctagttcgacggagactctctagttcgacggagactctctagttcgacggagactctctagttcgacggagactctctagttcgacggagatctctcactggaaggtaaagtactaggctgggaatagtggcagatgggaccagagatgtaagcaaagaccacaccacagtgagccttgaatgccaagtacatcagttatgggtcttagctgcaagcaacagaatctactctggtcagtctacatagcaaaaaaataaataaataaaataaaaataaaactgga

SEQ ID NO: 380972 - DNA, 392 bp, Homo sapiens
ggaaaagtcctagtagttaaactttgacacagtatcaaatgatatatgagttggctatactagcttcttggtaatttgacatgtacagacatctcaaatttgggggccaggcgtggtgacttacacctgtactcccagcactttgagaggctgaggcgggaggattgcttgaatccaggagttcaggactagcctggacaacatggtgaaaccctgtctctaccaaaaatatacaaaaaaatttagccaagtgtggtgctgggcacttgtagtcccagctacttgggaggttgaggtgggaggatggtttgagcctgggaggtggaagttgcattgagccaaaattgccccattgcactccagcctggcaacagatatatatataatctaaa

SEQ ID NO: 380973 - DNA, 262 bp, Homo sapiens
tttactttttaaaaaaaacttttatctgtttagaattttccctgattaaggagtgaaagataaattattttttttctagatagatacctgatttagccagcatttattgattaatctatcctccacaaatcagagataccaccttttatcctaaattaaattctcatctcgacagagttttagaatgagatggtgcatataattttgtgatgccaaatttggatgttctcttcctaatgcttcctaagatagtaattataca

SEQ ID NO: 380974 - DNA, 805 bp, Homo sapiens
tgtaaaatgatacctcaaagaaatcaatgctggaacccataggatcatatgtttcatggatgtgcttcaaaactatttctcaaagcaatctgttgcatcagtctttgggctaatgaaggctgccagtcacagttccatcatggaatgactggcatactctgtaatgatctataatactacaactacatcagaactgctctgccatacagatagtaccagatggtgatgtgattattgtaaaggcctcacactatccacctgtccttgcaaaaactcccttagcagacatgcacctagttgacatgaaagaacaattttgaaatgtgatttggaagtgttttatatctggcctactttgctttgaattattctttcatttgccaaagagctcttgcaaggtactgcacaatggctaggcaattattattattaatagtaaaaactgcaattgcttttgcaccaacttaaagagctaaagtctaagcttccagtctcccagcatccctcacacgatggagggcagcacttgagtctaatcatgcttgagatggtgattgcctgatatgtatattaaatactatgctgaagagacggatcctttcaatagtgtttttttcaagcatgttacatttagaattaagacctgcctagaaaataagctacatagtgctgaagaaacaaaaacttgacaagattcctaagttatcatttatatgtaatattcttcctacaacactgggtttggaaggataataaatacataaaaataaaattctgcagttaactaatatgaaaaagaggtaat

SEQ ID NO: 380975 - DNA, 386 bp, Homo sapiens
aaagttttagattttagtgcagaagttgtctttgaagattatcaaatcaaaacatccttattttagaaagatgatacagaaaatcataaggaaatctgagtgaacttaccacccttcacattttagggtatagtcatcaggtatttcaggagacttaacttgaacctaacgaaaccaagtttcaggcccctctaaatataaatgttcacttttatacctaagtttctgtttcaaatgttgttattcttgttcttaaagaggccactcaaaattgtgtaagcttcagggctcacaaaatgtggggtccatcactgtcatcaaggtgattaattgatttgtataaatctagttcctttctgttttatgatatgctttgtcatttaata

SEQ ID NO: 380976 - DNA, 2004 bp, Homo sapiens
agtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcatgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgggtggttgtgaaatgggattctccttttttcccccgggtgggctcccgggggtttgatccgggctcatggaacccttcgcccccaggttccaggggattccc

SEQ ID NO: 380977 - DNA, 3024 bp, Homo sapiens
agtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcatgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagtgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 380978 - DNA, 1086 bp, Homo sapiens
gggccccatatttgatctgtcaagaaactgttggctgggaactcctgacctcaggtgatctgctcaccttggcctcccaaagtgctgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 380979 - DNA, 993 bp, Homo sapiens
actagtgccgccgctgtgccatgtaccagctatgagcatctatgggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 380980 - DNA, 3427 bp, Homo sapiens
agtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcatgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagtgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggcgttcctgtcttctgtaaagctagtgagttgtcccaagagactgatgccacagcttgttcgcagtttacacaaactcagctttaaaattccaaatagaatctgacttgcaaactctagctgcagcatgtggagcttctagatgtttactaccttgaatggttgtcagtgtcactgaaccacaggggagaggagtatggggtagagcaatggtctgggccaaggaatggtgagcttagggtcttcctctgactccttactcctcaaggaggcagttagggtccctcttaagcaggcttctatttcttaccactaaattggtttcctttttcatccagaagttagaactccccagatattcacactataggatctgaattccgagattctaaaatatcttaaaccacaagagagaaaatctagttctgcctcagccccagtcagcaggccatctgtcccttcctctcctctgagtcagacagctctggcaagcaaggctccttggctagttcctaatgcactgacaggagccctcccattaaggacgacttctactcaaaatgcgactctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctataaaaaaaaaaaaaggggggggggctaaaaagtccgcggaggggcgcaagttagggtaccaagttttgtgaacagggcgcaaaggggggataaagaaaggagggcgggttaaaaggcggcggggaacaccgcgccggagacctggggaagggacgccatccgcgcgggggcacagggcggaccacaccaaagagtaacgtcgggaaaaaaacacaggggagcggtgaccacggcattcgggcggatggtcgcttagcagcaacatcaacagacgacggacacataaaacaagaacagagaagaagacagaaagacagagatgcatacaaacagcgcctgcacatcagactgcacttcgatccagccgctctcatctcgtccatagagagagggagggggggttgt

SEQ ID NO: 380981 - DNA, 2460 bp, Homo sapiens
agtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcatgattttaaggagtaagtttttgctgagtagctgaagtcagtgctcctttacttagctgcctctttggccttgtttcctgtggggttgggaggagggagatgtagtgtgaggtaggccttcccttggtctgtattcagcatagttgcctagatgctgctctgccttgtttgatggttgatcttaggaagctctaggttttactctgaggcctcaaaccctccccctatgcagtatagctgttgggtttttgtcctggacaaaggccacggctgttgtgctgcgcttcaggtttgtgaggctgcggagtggtacccccaccatgcacgcaagcacacacacacagatacttccctctccacccttttgggagctctttattttagaatgtaacttgaactcacttttatcattggcctttttcctcttactctgacttcctagcttagctctttccaaaaggaacttgaacttggccaagagaggtaaggaggctgagcagagcagtctttgctcattcctggttgttgccaccctcatttaaatggaagagagaaaacaggagcttcttggctgtttgccaaaatgaattgtccagggaacacagtgctctctgtaattaccctgcctttttctccaccccaacacaaaaatctggaaaggaaaataagtgggtaggattaagagctgttagaagctgaggaccaaaggacactgtgggtccattcatcaagggggagaccctcttcattagagtcctcatgaaattagccaaatgatgagtccttccctagctgggcatggtgggttctctttttttttttttttttttttttgttgttgttgttgagatggagtctcgctctgtcacccaggctggagtacagtggcatgatctcggctcactgcaacctccgcctcccaggttcaagcgattctcctacctcagcctcctgattagtgggattacaggcatgagccaccatgcctggccaggcactgtgggttctacaggatgggtctgtaatgtcacggtgagggctctctctagtagtagatctggagtgaggtgtgtcttgggttgaggaggtggcttgactttcgaatgtaaaactgactgtgccttagcatcaccctgtccagtgcccctggggcagctggtagtgtccagaagaatggacacctgctccagatttagatgcccatctgggcttttgtttgatttgcggctctccctctgaacttcagatgcctctgttagcaggaaaaggcattgattggattggatatatttatgtgactgcgggcatttgtggctgtagaatccgtgaccgtaatgttatatgtaatgggaactatcttataaacttgaaaaaaataaagtttttattttctata

SEQ ID NO: 380982 - DNA, 461 bp, Homo sapiens
ctgtaggggtaacacatctggcatggtgccgtggctaccttgctcactgcacatagtccacgtaggcaaaactcaaccacagtctgacacaggtcttggtagaaaacatcgtgatcctctctggatcctccatggcaagataggccatcgtaaaggagctgtcaaagggccatttatcttgcaaaatacctccctgtcttgcaaaaggctgccgtgagaattttctcatccagctggtttccagtgacctcactctcattcaggtgcagataccgactataaaaatgtttagctatagtttaggagttggctcctcaacagagctatttctacttgttcatctgttcatcttgttccccttggttcagtgttcatccaggggatgtccctaagggaccagggtattacaggggaggctgattcccttcctgatactgcttttgctgtctgtgtaaataata

SEQ ID NO: 380983 - DNA, 411 bp, Homo sapiens
actagttctagatcgcgagcggccgccctttttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380984 - DNA, 3791 bp, Homo sapiens
cgcgcgcaggcagacaagctgttcgcggcgaccggagagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380985 - DNA, 3784 bp, Homo sapiens
ggggcgcgagctgccgggggttggaggtcgagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380986 - DNA, 3772 bp, Homo sapiens
cgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggttttttttttttttttttccaaaaaacccccccccccccttttttttcccccccccttttttttttttaagctttttctaaagcccag

SEQ ID NO: 380987 - DNA, 1601 bp, Homo sapiens
caaggactgcctggacagatccttgcacacgttgtgctggcacacggtcgtgatgggccggaacaccagctcctgacagcagaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380988 - DNA, 1585 bp, Homo sapiens
  misc_feature (13)..(13): n is a, c, g, or t
  misc_feature (17)..(17): n is a, c, g, or t
  misc_feature (64)..(64): n is a, c, g, or t
gtccatgtcctanaagnaagaacgtccaggattgctgcagactgtgtcggcccatacgacgggncacacaaggtgtcagactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380989 - DNA, 374 bp, Homo sapiens
ggcctctgcacactgtcgggaggggccgtcccacctcggctcgtttcccattgagggaaggaggcttggtcttagcacggggtctaaggcccgggctttcctcccagctacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctggggtgagcctcgcgtcctggggcgagcccttcctctctcctttcctcccctcc

SEQ ID NO: 380990 - DNA, 3826 bp, Homo sapiens
cgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380991 - DNA, 3800 bp, Homo sapiens
cgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctttttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380992 - DNA, 3404 bp, Homo sapiens
cgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggcgttggatgcattcgactgcatccaacgccgccttcaaagtcctcgttggaatattttgctactaaccaccaagatctgcaccttggggggatcccacccggggcccggcgccccttaggtttcaagggctcaccgaagcggcccctcctactcgtcgcggcgtagcgtcggcgcggggttggatgcagtcagggcggcgttggat

SEQ ID NO: 380993 - DNA, 1550 bp, Homo sapiens
  misc_feature (8)..(8): n is a, c, g, or t
ccgggtantggtatcgtcgaccagcgtcggccaacgtgtgccggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaatgt

SEQ ID NO: 380994 - DNA, 166 bp, Homo sapiens
ccctacctcagtccctccttcctcctgacacaccctgtggcttaggactgttgaccccgaagcctccacctcacctagcaccccacgccacccctacccaaacaggggaggaggcggacgtgccttggaaccacacccaaggaggtgagtctgagctgggccgggg

SEQ ID NO: 380995 - DNA, 430 bp, Homo sapiens
gatcccacgaatgacacgggacaggtttgtgcagttggttggacgtctactttgcccctacagaggggttttggcaagaagtcgactgacttctgccattgacctggggaatcagccaaacaataagatcagtacgggttgaatagaggttggagaactgggctcatctgtgctaaggaggggatgggaaaaaagtcccacagcgaatcttggcgctggggataggtaccatctccacatgttccttgacatttggagagacgatagagagcgtaggtcaggcaatgggaagcaaacttcggctagaagtctgtcaggaaccccaaccccgcacatgcgctttggtcagcctggccgttgggttttccccacgaactgctgcatctccacgcttcaatgcccgtggccaggttggtctgactaacgggac

SEQ ID NO: 380996 - DNA, 851 bp, Homo sapiens
tgaaatcaaatagtttgttctctgaccacaatgaaattaaattggaaaccaaaaacaataagataactaggaaaaccccaagcatttggaaactaagcaacacacttctaaatatttattgggctaaagactaaatcacaagagagattgaaaatattttgccctgatgataatataaatacacatttcaaaatttgtgcaatgtagctaacatagcactttgagggaaatttacagttttgaaagcctatacgaagtggggaaagttcttaaatcaatgatcttaattttcactgttaaaaaatagaaaaaaaagagtaaattgaactcaaagcaagcagaggaagaaaataataaagataatgacagacatcaatgaattagagaacgaaaaaaagagataaaaaaatcattaaaagcaaaaagcagtcctttgaaaaaactaataaaattgataaatctcaagactgactggcaaagaaaaaaaaatgaacaatatcaagaatgagagaagggacattattactttggatattaaaagaataacaattctctattgttatgaacaactttatgacattaaatgtgtcacagatgaaatgaacacattctgggaaatacataaattataaatctaatcaaagatgaaatagaaagcttgaacagccctgtatcaattaaagatattgaatttgtaattaaaaacttactgagagaattctgggtttagatgcttcattgatgaattctgacaaacatttatgaaaaaataataccaatcctacaaaaactgtttaagaaaataaaggaggaggcatgattttatgatgcagtattattctaattctaca

SEQ ID NO: 380997 - DNA, 1289 bp, Homo sapiens
aagaagtcaaagcttgctccagcttctttatactttcccttctgcatgcttgcagataaaactcagatttgtgatgccaaatttttgatgtagacagtgtttggaagttgctacccctggacttacgaattgccttcatagaatctagggttatcctcaccatttttggtacagctgatttacaggcaacttgaaataacaacaacaaatccctcatgaatcagccgaagcgtgacagggaggtggggtaaagtgggtacctccacccagttcaccagtatttcccaaaccactcccaagcatttccttcacctgggcctcagcctgaccaaagatgaacctcagcttattgagtggtaaggaaaatgggatcattagagaaagggggaatgcctttgtcagcttggcttaataagatcacaacccatcagctgacgctgatgactcaaggagggaggctgaagtcagggttagcgctaggcccaaaggccagctttttgggcaaattactctgagaactgcacagccacaccatctgccctctgcagcattgccccatctggagcaggtataatgaggggcagcatcatcacaaagtggcacctgaagtattggtggctttggaatcagtctaagtccaagtatttcctctgcccgttacaagttgtataaagttggacaacttaaagtgtcagagtcccttgatttaggcacgattcaaggcccagcttgcgttcctacaggacaactatgctctgtcaatgcacttcagtgagctatttctgccctccccatctgtccatgagctccttgagtgcatccttatacatttttgttgctccagtctctggcatggtccctgtcacaccataaggcctctaaacatgtataatgaattaataaatactgaaaaattgtgatggtcactggaggctcggtggtgataagccttattatctgctctatattatacatcctattatgaacatgccgtctttgagagcacattaaacaaatgcattaatgcaaggatgaacacttaccaaggattaagtgtactgaatacaagaatccagaacagctaaaagaaaaatacttgtaatataatgattgtgtccatagaacaactgtgttataaacaaaagaagtccaaggcaaattgtgttattttcccagtagttttgtgatctgttttgtgttcttacggtaaggcctgataagaaccatgttccacaatgcatgtgtaagcatgacctaaaaatacatatagtttaaattcctgcctaaca

SEQ ID NO: 380998 - DNA, 718 bp, Homo sapiens
taagtttcaacactcaggcccggcgcggtggctcacgcctggaatcccagcactttggaaggccaaggcagacagatcacttgaggtcaggagtttgagactagcctggccaacgtgatgaaacactatctctactaaaaatacagaaactagccagcacaaaaatggcacctgtagtcccaactacttgggaggctgaggcaagagaatcgtttgaacccaggaggcggaagttgcagtgagccgagatgatgccactgcactccgcactggacaacagagtgagactctgtctcaaaataaatacattaattaataataaataaaaagtacaaaaaattagctgggtgtggtggcacacacctgtggtaccaactacttggtaggctaaggtgagaggagtgcttgagcccaggagatcaaggttgcatcaagtcgagatcgaaccattacactctggccttggcaacagagtgacgccctgtctcaaaaaaaaaaaaaaaatgttgactccctaaaaacatgactgctaatagtctactgttgaccagaagccttaccaataacatagtcaaataacacatagactagtatctacatatattttatgcattcaagacatacctaacatttcttaatttttgccatatttctagtctatgtggttcacctgcaagatttttcaaattgttgccaatttgaaaaaggaaaaaaaaaa

SEQ ID NO: 380999 - DNA, 478 bp, Homo sapiens
gaaaatccagccctggctttgcgtcgagctgctgagtgccgcgcttacgcgcgcggggccagccggggcctggtttccatctgccccttttgcctccgtgttaagttcgccggggaaaacccaacgatccgtgctgagcccctcggaggagagcccccgccccaccccacccccagcccgatcccgaccgatggaaaaaatgacagtataggtcagaacaggctgcccgcgagtattaatatggacggcctccgttcctggtgcttggggaggatgggcgcttcgccaggaaaccgccgaaggaggcgccatgagggccgcctgccccttctcgggctagaaaacgtggattctcagagggaccagacaaatgtggtcagatagctgcaggaacttaccccatctaaatacaggttgcccgtgtatattccaaccaagatcatttttgtttcaatctaatacacgttgaatcaattag

SEQ ID NO: 381000 - DNA, 488 bp, Homo sapiens
tggcacgaggagatgcaatcgcaccttatgttcccatctagtttggagaacagcccaaggagtttttcaggctctagacctcaagatccttcttacctctccacagaatcaacttctttctctgacaagggagaaaggcaaggagaggagggaggctttgctactctctcctgatacctagaaaatctttctggagccaaagggctctgagttgagtttgcaagaggggaggacaaagaagggagtgtgtgatgattttaagcataaaggggatgatgtgggagaattttggaattttttttagggaagtggctgttcaagggaagaactctattgtccaaggagagaaaaggctgggactggtccatcagtgaagagcactttttgcccattatcttctccccataaaggatccactctttggaagcgccccctggggccttggaacatgaagatggctcagatgcccataattccagtgaggcctc

SEQ ID NO: 381001 - DNA, 526 bp, Homo sapiens
gtcagcttaccctgaggcgcattgaccactgggagagatgtggatatagaaatccaatcatggatcattaggaagaaggaagcgttggataggctctcagcatggtccaccacagttgcattaaggattgtgtattacgttttttacttatgtgaaacaccaccttcccccatcaagcctgtaagtatgaagtcgagtccctagtgaatctactctctgactcctgtgtttcaagcaccctcattagcagagcttatatagttcggagttgaagaatttttttttcccaaaaattctcttctcatttaatagacacctgtctgtagagtaaactatgcaggccataaatggaacaaagatagtttaggaaaatacagtttcttaaataaattacttttaaaaagtatattttctctcagctcttctctccaaaggagttttgtatcataacctctgtagtaaatagtgtcatctttattgtctgattataaaggtgaagtataatttatgggataatttacaaagc

SEQ ID NO: 381002 - DNA, 403 bp, Homo sapiens
cgatttttagtcggcttttgtgcaaatgagtgctatgccccaagctctgaaaggggaaacgtcaccactcacaggtagcagaagggcaggcatttggaaggaagttagtattcagtggggaggagctggagttttatttcttttcttccactcatatgaccctctttctcccctctttcagatgctgtttgtttcataccagtgtatctaatttgcaaaaaatatgtagaacttatgaaaggttgtttagtagatggggggataattggctcactctatggagaaaaaaacaacaaaacttatccctacttaacactgtaaaggaaataggacaaaaaatgtaggcgaatatcatgggagagggatggggaaggatttctcatacaaaacttcaaaagcataa

SEQ ID NO: 381003 - DNA, 334 bp, Homo sapiens
caggaactcacagatcattctttcttttccatctcattcttagcacgctaatccaacctttgcaatcttaaatctaggacaaagcaatagaaggatttgggctatggagaaaagagaactcattttggtgtctaaagacctggatctgactttcagccttgcaatacttttaggaggtgaaatcactactctgggggaaatatctgattcagaaggttttgggcgggggggatttaatgtatgcagaagcagtttgtaaactgtaaaatctctatacaagaggaagagaactggctgcactccagcctgggtgacagagtgagagttctgcctc

SEQ ID NO: 381004 - DNA, 421 bp, Homo sapiens
ttccgcctcccgggttccagtgattctcctgtctcagcctcctgggtagctgggattacaggtgtctgccaccacgcctggctaatttttgtatttttagtagagacagggtttcaccatgttggccaggatggtctcaaactcctgacctctgcccacctgagcttcccaaagtgctgggattacagtcgtgagccaccatgcctggccaaaatttactttcttatttacatttttccatactgcttgatgttttagtttgtgaatatatcattttaccaatataatttttaatatttaacttttaaaagaacgaaaaaagagaaacaaagtgactctagattaactttactttttttttcttttttgttttttgtttgacatggagtattgccccgtcgccagactggagtgcagtggc

SEQ ID NO: 381005 - DNA, 463 bp, Homo sapiens
gtatgccaccatacctagctgatttttgtatttttaatagagacggggtttgatcatgttggccaggctggtcttaaactcatgatctcaggtgatctgcccacctcagcctcttgaagtgctgggattacagacatgagccaccatgtccagcctgaagttatttttcaaaagtggtactttggaggaaactgatgtaatgatagaatgtcacacttttgaagggaggagtataacctatagagtctggggttctattttattttatttttcaagacaaggttttgccctgccacctagcctggagtgcagtgatacgatcacggctcgctgcagccttgacctcccagctacttgggaggctaaggtgggaggatcgctgagctgaggaagttgagacttcagtgagccatgattgcaccactgcattctagtctgggtgacagagtaagacctaatctca

SEQ ID NO: 381006 - DNA, 1214 bp, Homo sapiens
ggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381007 - DNA, 1905 bp, Homo sapiens
ggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381008 - DNA, 1776 bp, Homo sapiens
ggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381009 - DNA, 1351 bp, Homo sapiens
ggagaagcaactgttggagtcagctgcctgaggaatatacttctctaggctggggtggggaaatgagcttgaagacaaggaactggctgagtcttaatttgggcgagtgaaagaaggtgactgagccaggaggagagcacagatggcttggtggtggtatggtgtgctccatcggctgccaacctagggccatcgtctgcctccatcacccctccgcccgcccgcctacccacccaatcccaaacgggtgctggatcaggtgctgaatccggctgcctcctcgggtcctccttccccttccctcttaggcatggggagtggagcaacagacggagagtggcatgaagacacaaaggaggaagcacaccattgccaagaccccaaggaagaaggatggaaagcgctggcagtcctgcctggcccccagccagttccctgctgaagatggccagatccccttgtctggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381010 - DNA, 927 bp, Homo sapiens
caatttgcctgcctcggccttccaaagtgctgggattacaggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381011 - DNA, 399 bp, Homo sapiens
ccacttttctcttttggaggcacctgctggaccatgcagtgggggagggcctccggattaaaaattttttttttaatagagacaaggttttgccgtgttgcccaggctggtctggaactcctggactcaagcaatttgcctgcctcggccttccaaagtgctgggattacaggtgtgagcctctgtgcctggcctggattatttttgtaatgggaattgttttagcaattttctaagtttgcttacagttctgtgaaatctcgttttctctttaacagtagctaatttggatctagtccttccacgtgtctaattccagccaacctgcctcatttagttctcatacctatagccagatctccttcagtttcatttctcagttccctgctttgactcttc

SEQ ID NO: 381012 - DNA, 2175 bp, Homo sapiens
ggctcagcctcaggcatgagacctgtaccagcccccgggagccgtgcggggccaacaatgaggagcagaatgcaaggggcggcctcgctcccctggccaccgcgggggtcgcggcctcccattacatagcgcgtgtctcgagccctggcctgctctcggcaccgccacaacgggcgtaatatggccgctggtgccgggacctgccgggcgcgcggagggtcgggccgaggtccgggatccggaactgctcccggcattcctcgcgagtgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctccctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctcac

SEQ ID NO: 381013 - DNA, 967 bp, Homo sapiens
ccctaaacagtttaattttaattatagaatgttcatctacaaagtatctagaggaggcttttgctttattccatttctgccaaacttaagagaaaatgtactgatgaagggaaacatatccacattggaaaacatttgactgtctaatttttcagaccttgattcttatatcactcaatctctgtttattgtgccaaagactgagaatcagtgcagtggaaagcctgtttttgacgtcaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381014 - DNA, 445 bp, Homo sapiens
  misc_feature (18)..(18): n is a, c, g, or t
  misc_feature (24)..(24): n is a, c, g, or t
  misc_feature (26)..(26): n is a, c, g, or t
  misc_feature (29)..(29): n is a, c, g, or t
gactggtgttctagaggntccccncnggnggaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381015 - DNA, 7098 bp, Homo sapiens
taaaaagtttaatttaaaaaaaaaaaattaagaacaaaaaaattaaatccaagcctgttcttttcacaagatttaaatttgctcattttattttccattcagaattatggccagccacaatggagattgtgccgttaagtaacatgataacattaatatcatctagtaaagaaatatcaacagtatatagttgcactgtgttttagtattaactaccttcttattataaaatcttaagggagaattaaatttcaaatacccttgcatttcaaaaactttaaagttgtaagatattgaaataaaaaataaaattatcttctcatgagttcattttttgtattaaagtttaaaattagtgttcctcaatttgtgttgttcagtttcaccttgatggtttgagttttttcagtcggtgaaacctgacctccctgtctctggaaagagtgtagttctttcagggctttccgtgtaacctcagggtctgttgtattgaatttttaaagagattccagctatctatatggaacagaagattatcaaagcataggccctatcctaaaaaaaaaaaaaaaaatccaatttctcactcttggaaaaattaccctaggaatcaccacattcccagaatctaatacttggtttgccagagaccatagcaggaaccagtagtatcaagttggggtagacagagtttgtctttccattatttcagtcatttaatgccggatgtcctgagcccacaacctatgaaattaaacttagaaatctttatcacatgcttccatcttaaaataaaacatcaggagtagcgttcctttcctgatacctaacattccttttggaggaaagttatgtgtaaaattctagattaatgcatatggcttttgtctttcagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaagtaagttatcttttcatatgtaattatgatagttttaataattaatggcactacagttcctcttaaaatagaaaacatactgtttgtaaagaagaaacatttaagagtagccaaaatagctcagctgggagagcattagactgaagatctaaaggtctctggtttgatcctgggtttcagaagaaacagttcattggctaataataagaatgaaatcataaaaatcgtattaccattgtgttttaaggttaaaattgtttaaaaaaagattattttctcaatctaactgttagacaataataatagtaaaaatttatttaacatgtaatgttttacctacattaactcttctaacccaaataacaatcttacaggtggaagagataattatctggaattttgaattgaggaaactgtggcctatagtggttaacatgtataaggttgcacggtaaatgagtgtctgccatctgatttgagaatttttcatcctaacagtatattgcccctgtcaagtatattaacaagtatttaaatagtccagcaggagactgaatttaactttcatgattcttcttcaaagtcaagtttacttcctcattgatcccataacaagagtgataagcactatttattaaggcagaagtactttcccttccttatcttaaggattttatgcaatcatataatgaattgagcctcctaagttgaaggcagagaaatgaattctatattttgtacaaagactgctgtgattccatgtcattatttgtattgaatttttttttcctggttgagaagtagtaacagcattttaaaagcttacttagctgttatcagctttcatttttacataatgaaaaattcaggattattcagttttttttttttttttaataaacatccctgcttcattctcattaatggacataatctttgagctcctttttgattaatgtgttttaactgaggaatgcaggtcatttcagtataagaaaacaccaaacataattaataaggtaaagtttgtgccctttctctaccttattctctaagaaatctattgctttccaatggtttgggggctattattgctatgcttttgttttccttattgaaattagtaattaagcattatcctctgaagactcttatgtctgtaattttttataagtgttataactatgtgtatgtgtatctgttttttcaaagagaatcagtagaactacatgagatagtatattcatatttcagtgaaataatttagatgaaaattgttaatacatttgaaagtctgtgaaatgtatttctttcaaacggctactttgaaatgtctttgaagtcagattcatgaaatacttaaagcatttgtattgtatatttctaaaaataaatccatggcatttttttagatgtgtatagtttgtttaaaaatactttttttagcagatagtcttcaagatattaagtattccttgaaattttgattattatactttttaattgagttatttggcaaaatttcaagcaattgatacatacaaagtaatgtgatggatccttttaatacagtttcataggatagataaatctgtaagaaagtataatataaggaaaactgtgacaagtagtaagagaattgtataaaagtttagataagaataggattacttttagctgtgatgatggggattcagatacaggggaggagaagtctgttaagacattgtatacaaggtgtagatactgatagattctggaaatgttagatgaaaagaaagccattccagggataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381016 - DNA, 2934 bp, Homo sapiens
  misc_feature (26)..(26): n is a, c, g, or t
  misc_feature (40)..(40): n is a, c, g, or t
tcgcagctgtacgccccgccgattantggcatatcgtcgnaccgagcgctcgggaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381017 - DNA, 4919 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381018 - DNA, 6527 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaagtaagttatcttttcatatgtaattatgatagttttaataattaatggcactacagttcctcttaaaatagaaaacatactgtttgtaaagaagaaacatttaagagtagccaaaatagctcagctgggagagcattagactgaagatctaaaggtctctggtttgatcctgggtttcagaagaaacagttcattggctaataataagaatgaaatcataaaaatcgtattaccattgtgttttaaggttaaaattgtttaaaaaaagattattttctcaatctaactgttagacaataataatagtaaaaatttatttaacatgtaatgttttacctacattaactcttctaacccaaataacaatcttacaggtggaagagataattatctggaattttgaattgaggaaactgtggcctatagtggttaacatgtataaggttgcacggtaaatgagtgtctgccatctgatttgagaatttttcatcctaacagtatattgcccctgtcaagtatattaacaagtatttaaatagtccagcaggagactgaatttaactttcatgattcttcttcaaagtcaagtttacttcctcattgatcccataacaagagtgataagcactatttattaaggcagaagtactttcccttccttatcttaaggattttatgcaatcatataatgaattgagcctcctaagttgaaggcagagaaatgaattctatattttgtacaaagactgctgtgattccatgtcattatttgtattgaatttttttttcctggttgagaagtagtaacagcattttaaaagcttacttagctgttatcagctttcatttttacataatgaaaaattcaggattattcagttttttttttttttttaataaacatccctgcttcattctcattaatggacataatctttgagctcctttttgattaatgtgttttaactgaggaatgcaggtcatttcagtataagaaaacaccaaacataattaataaggtaaagtttgtgccctttctctaccttattctctaagaaatctattgctttccaatggtttgggggctattattgctatgcttttgttttccttattgaaattagtaattaagcattatcctctgaagactcttatgtctgtaattttttataagtgttataactatgtgtatgtgtatctgttttttcaaagagaatcagtagaactacatgagatagtatattcatatttcagtgaaataatttagatgaaaattgttaatacatttgaaagtctgtgaaatgtatttctttcaaacggctactttgaaatgtctttgaagtcagattcatgaaatacttaaagcatttgtattgtatatttctaaaaataaatccatggcatttttttagatgtgtatagtttgtttaaaaatactttttttagcagatagtcttcaagatattaagtattccttgaaattttgattattatactttttaattgagttatttggcaaaatttcaagcaattgatacatacaaagtaatgtgatggatccttttaatacagtttcataggatagataaatctgtaagaaagtataatataaggaaaactgtgacaagtagtaagagaattgtataaaagtttagataagaataggattacttttagctgtgatgatggggattcagatacaggggaggagaagtctgttaagacattgtatacaaggtgtagatactgatagattctggaaatgttagatgaaaagaaagccattccagggataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaatctgaaaaacagaagcaaaaacagattaaaaaggaaaagaaaaaagtaaatgaag

SEQ ID NO: 381019 - DNA, 3382 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacagtggtgatctttccacccatttactgatctttagcagtgtttctcaactttttgtatataggaatgcacataagattatggggattatgttaaaatgtagaatcttattcagtagatttggagtgggacctgagattctgcatttctaacaagtcccagtaatgtcgatgctgctggtctttagacacttaaaatacaattcctagatcctagatacagtttttcctagaggctgacatgatttgatattcactgtctttatattgtattttataaagcaaggcaaggtatttcattttctcctagataacattaaaatatttgttcattgatttttaatataatatataataaaaattttgtattcgtattatg

SEQ ID NO: 381020 - DNA, 553 bp, Homo sapiens
acaaacttatctatttattttagatattgcctcagcatttgtggcccccgtggatctgcaagcctatcccatgtattgcacagtagtggcatatccaacggatctaagtacaattaaacaaagactggaaaacaggttttacagcaggttagaaccatttgatgtagctactatcaaaggaaagctggtgatctttccacccatttactgatctttagcagtgtttctcaactttttgtatataggaatgcacataagattatggggattatgttaaaatgtagaatcttattcagtagatttggagtgggacctgagattctgcatttctaacaagtcccagtaatgtcgatgctgctggtctttagacacttaaaatacaattcctagatcctagatacagtttttcctagaggctgacatgatttgatattcactgtctttatattgtattttataaagcaaggcaaggtatttcattttctcctagataacattaaaatatttgttcattgatttttaatataatatataataaaaattttgtattcgt

SEQ ID NO: 381021 - DNA, 381 bp, Homo sapiens
cgttcacatagagctataagagtgactgacaatactattttatttacagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaagtaagactcactttctaaattgaaatgtatatgatgattttcttaatttaagcttttactttgccaaatgca

SEQ ID NO: 381022 - DNA, 361 bp, Homo sapiens
aggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggtatgtaatatttcattattattaccatattgatattctctatataaaaaaatttacatattgtagttttcaggtaaaagctgttgtgaacattattttttgtctagtgtagttaatttaa

SEQ ID NO: 381023 - DNA, 2468 bp, Homo sapiens
aaaaagcagtgacagcagccatgcatttcagaatgatgagttagtttttgttcttggccaggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381024 - DNA, 7756 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaagtaagttatcttttcatatgtaattatgatagttttaataattaatggcactacagttcctcttaaaatagaaaacatactgtttgtaaagaagaaacatttaagagtagccaaaatagctcagctgggagagcattagactgaagatctaaaggtctctggtttgatcctgggtttcagaagaaacagttcattggctaataataagaatgaaatcataaaaatcgtattaccattgtgttttaaggttaaaattgtttaaaaaaagattattttctcaatctaactgttagacaataataatagtaaaaatttatttaacatgtaatgttttacctacattaactcttctaacccaaataacaatcttacaggtggaagagataattatctggaattttgaattgaggaaactgtggcctatagtggttaacatgtataaggttgcacggtaaatgagtgtctgccatctgatttgagaatttttcatcctaacagtatattgcccctgtcaagtatattaacaagtatttaaatagtccagcaggagactgaatttaactttcatgattcttcttcaaagtcaagtttacttcctcattgatcccataacaagagtgataagcactatttattaaggcagaagtactttcccttccttatcttaaggattttatgcaatcatataatgaattgagcctcctaagttgaaggcagagaaatgaattctatattttgtacaaagactgctgtgattccatgtcattatttgtattgaatttttttttcctggttgagaagtagtaacagcattttaaaagcttacttagctgttatcagctttcatttttacataatgaaaaattcaggattattcagttttttttttttttttaataaacatccctgcttcattctcattaatggacataatctttgagctcctttttgattaatgtgttttaactgaggaatgcaggtcatttcagtataagaaaacaccaaacataattaataaggtaaagtttgtgccctttctctaccttattctctaagaaatctattgctttccaatggtttgggggctattattgctatgcttttgttttccttattgaaattagtaattaagcattatcctctgaagactcttatgtctgtaattttttataagtgttataactatgtgtatgtgtatctgttttttcaaagagaatcagtagaactacatgagatagtatattcatatttcagtgaaataatttagatgaaaattgttaatacatttgaaagtctgtgaaatgtatttctttcaaacggctactttgaaatgtctttgaagtcagattcatgaaatacttaaagcatttgtattgtatatttctaaaaataaatccatggcatttttttagatgtgtatagtttgtttaaaaatactttttttagcagatagtcttcaagatattaagtattccttgaaattttgattattatactttttaattgagttatttggcaaaatttcaagcaattgatacatacaaagtaatgtgatggatccttttaatacagtttcataggatagataaatctgtaagaaagtataatataaggaaaactgtgacaagtagtaagagaattgtataaaagtttagataagaataggattacttttagctgtgatgatggggattcagatacaggggaggagaagtctgttaagacattgtatacaaggtgtagatactgatagattctggaaatgttagatgaaaagaaagccattccagggataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381025 - DNA, 4964 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaacaaaaaaaaaaaca

SEQ ID NO: 381026 - DNA, 7815 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaagtaagttatcttttcatatgtaattatgatagttttaataattaatggcactacagttcctcttaaaatagaaaacatactgtttgtaaagaagaaacatttaagagtagccaaaatagctcagctgggagagcattagactgaagatctaaaggtctctggtttgatcctgggtttcagaagaaacagttcattggctaataataagaatgaaatcataaaaatcgtattaccattgtgttttaaggttaaaattgtttaaaaaaagattattttctcaatctaactgttagacaataataatagtaaaaatttatttaacatgtaatgttttacctacattaactcttctaacccaaataacaatcttacaggtggaagagataattatctggaattttgaattgaggaaactgtggcctatagtggttaacatgtataaggttgcacggtaaatgagtgtctgccatctgatttgagaatttttcatcctaacagtatattgcccctgtcaagtatattaacaagtatttaaatagtccagcaggagactgaatttaactttcatgattcttcttcaaagtcaagtttacttcctcattgatcccataacaagagtgataagcactatttattaaggcagaagtactttcccttccttatcttaaggattttatgcaatcatataatgaattgagcctcctaagttgaaggcagagaaatgaattctatattttgtacaaagactgctgtgattccatgtcattatttgtattgaatttttttttcctggttgagaagtagtaacagcattttaaaagcttacttagctgttatcagctttcatttttacataatgaaaaattcaggattattcagttttttttttttttttaataaacatccctgcttcattctcattaatggacataatctttgagctcctttttgattaatgtgttttaactgaggaatgcaggtcatttcagtataagaaaacaccaaacataattaataaggtaaagtttgtgccctttctctaccttattctctaagaaatctattgctttccaatggtttgggggctattattgctatgcttttgttttccttattgaaattagtaattaagcattatcctctgaagactcttatgtctgtaattttttataagtgttataactatgtgtatgtgtatctgttttttcaaagagaatcagtagaactacatgagatagtatattcatatttcagtgaaataatttagatgaaaattgttaatacatttgaaagtctgtgaaatgtatttctttcaaacggctactttgaaatgtctttgaagtcagattcatgaaatacttaaagcatttgtattgtatatttctaaaaataaatccatggcatttttttagatgtgtatagtttgtttaaaaatactttttttagcagatagtcttcaagatattaagtattccttgaaattttgattattatactttttaattgagttatttggcaaaatttcaagcaattgatacatacaaagtaatgtgatggatccttttaatacagtttcataggatagataaatctgtaagaaagtataatataaggaaaactgtgacaagtagtaagagaattgtataaaagtttagataagaataggattacttttagctgtgatgatggggattcagatacaggggaggagaagtctgttaagacattgtatacaaggtgtagatactgatagattctggaaatgttagatgaaaagaaagccattccagggataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgatgggagcaacaaacagaaagaggagaagcaaatgtaattaatactgtgtggttgattctacgcagatttcttctcagtgcttatgctagatgaatatgatatagaagttgcgtcggctgttccctcaggtagaccgtattcctctagtgtgagtctcttgatgtactgagcctgaatctagattttataatctaccatataatttttatactacatgatgtgtaaatgaagctattcttatctagggctccagcacgcacaaagtgcttagttctcactgactgatggtccgcaagattc

SEQ ID NO: 381027 - DNA, 3423 bp, Homo sapiens
ggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaatttgtattagatgaacagactcagcaagcacctcatcttatgcctccccctttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcaggtatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacctgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacagcaggttagaaccatttgatgtagctactatcaaaggaaagctggtgatctttccacccatttactgatctttagcagtgtttctcaactttttgtatataggaatgcacataagattatggggattatgttaaaatgtagaatcttattcagtagatttggagtgggacctgagattctgcatttctaacaagtcccagtaatgtcgatgctgctggtctttagacacttaaaatacaattcctagatcctagatacagtttttcctagaggctgacatgatttgatattcactgtctttatattgtattttataaagcaaggcaaggtatttcattttctcctagataacattaaaatatttgttcattgatttttaatataatatataataaaaattttgtattcgtattatg

SEQ ID NO: 381028 - DNA, 2248 bp, Homo sapiens
  misc_feature (2037)..(2037): n is a, c, g, or t
  misc_feature (2043)..(2043): n is a, c, g, or t
  misc_feature (2049)..(2049): n is a, c, g, or t
atatcacataatgatatgtttaatttaacctcagttttttaaaccagaatgcttctaccataaaagaattgtgatttcagttatacttccatcaaggaatatgtgggaagatatacatattgtcaaaatggttgggatgggatagttacaaaggacacttttgtatgttgtatgggatcacttgcctgatagtataaggaacattgtatgaaaagatgaaaagatacttcatttttagaaactgatcagagatgtcactggtctttaagtgatgtcttgaaaatccagtatgtatttgcccaaaagttttagcctacatctagctagcttacacttagcagccaaaccatcattgtgtaggttctgttttggaggaagctcatgggggatctgtgtatttcttaggtttctccctgttctccaatgttttatccatttcgtagcttttttactgtctccagaaagtagtgtgggacctgcacttaggggaataccagaatcatagcgtggttctgccttcttgatgagtgattgtgaaaaacacctgcataagggtgctaattggttgtgtattttttcatttatttgaaatcaaactgagaacacctcttttcggtttacagcataacatggcttgaagtaaaaggcagtatccaagtccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagctaatgtgacttttcagcttatcaagaggatggccaataaaacttaaaggtgtggttagatgttttctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaaaaaaaaaacancaaganaaaacnaacaaaccgctgtttgggccacgccctcggcgccccgtgaaaaaagcatgtgtgtaagagaacactttacgatagggtgccgccgggtgccccatgacggtatagtgaggacaaaaggggcacaacacgcggttccccagagacaaaaccgaggactaggaacgtggtggcgtggtagtttcacacaattaaagaagcg

SEQ ID NO: 381029 - DNA, 759 bp, Homo sapiens
ctcacttttgtgacattaatttatcactgagtctcattcaaccaagtaatctaaaatactgtgcaaattctagcagtatgtcttcgataacttggatgttaggatagccaatatgtacaaaaaattaaatcaagtattttgtcctatgtataacacaaattaattttacacagagaaagatgtttctaggcaagtgaaattctggtaattcatactatttctttgtatgaacaaataaaatatattttgccaacatgtgggtacctttatgttttcttaagtattacagaaggacaaggtagcaatattttgtttaataatcccatgtgcgtgcatgcgcacacacacacacacacacacacacacacacacacacacagagtcattctgagggcaagctgatctttcagattttaaagggtccaatccaatatacaactaatccacaagcatttagggtggattttttttttataaatgactctgaagacaagatcggcgagaggggctcgtgtgtcttggtggagcttccccgcagcccccaggaagtgctgtctattacacaggattccaagaatactgaagccgctgcctgccccggtctttcagtgccacaggttcgtgtgcatgggcagccacatgtcacacgacaggtgcaatgtgagcacagcacctatggctggatggattttgataataggtgccttctcttctcacttttgcagagtgttctcctattaggtggagatccttatctgt

SEQ ID NO: 381030 - DNA, 1197 bp, Homo sapiens
gtgaaactttaggaaggtctgagaagccctcttccctttaaaaaaaaaaaaaaaaaggctgcttctcgcagagtggaaagccccggtccccatcccaccaaaaccatttgacaagcaggacaacgaagaggcagaaggatctgggcctgtgcgcgacgccccgggggacgaggctcatggagaagtttcgggcggtgctggacctgcacgtcaagcaccacagcgccttgggctacggcctggtgaccctgctgacggcgggcggggagcgcatcttctccgccgtggcattccagtgcccgtgcagcgccgcctggaacctgccctacggcctggtcttcttgctggtgccggcgctcgcgctcttcctcctgggctacgtgctgagcgcacgcacgtggcgcctgctcaccggatgctgctccagcgcccgcgcgagttgcggatcggcgctgcgcggctccctggtgtgcgcgcaaatcagcgcggccgccgcgctcgcgcccctcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttg

SEQ ID NO: 381031 - DNA, 1382 bp, Homo sapiens
gtgaaactttaggaaggtctgagaagccctcttccctttaaaaaaaaaaaaaaaaaggctgcttctcgcagagtggaaagccccggtccccatcccaccaaaaccatttgacaagcaggacaacgaagaggcagaaggatctgggcctgtgcgcgacgccccgggggacgaggctcatggagaagtttcgggcggtgctggacctgcacgtcaagcaccacagcgccttgggctacggcctggtgaccctgctgacggcgggcggggagcgcatcttctccgccgtggcattccagtgcccgtgcagcgccgcctggaacctgccctacggcctggtcttcttgctggtgccggcgctcgcgctcttcctcctgggctacgtgctgagcgcacgcacgtggcgcctgctcaccggatgctgctccagcgcccgcgcgagttgcggatcggcgctgcgcggctccctggtgtgcgcgcaaatcagcgcggccgccgcgctcgcgcccctcacctgggtggccgtggcgctgctcgggggcgccttttacgagtgcgcggccaccgggagcgcggccttcgcgcagcgcctgtgcctcggccgcaaccgcagctgcgccgcggagctgccgctggtgccgtgcaaccaggccaaggcgtcggacgtgcaggacctcctgaaggatctgaaggctcagtcgcaggtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttgagtgctttttttcttccaaattgtggaattttatatctgaaattaaaatatagagcttaacctctttataatattatttaaaacaaacaaaaaaagaaagtgattcatccaaagtaaaagctagaactaaaagaagtcttatatccttgttctagagtccttttcaaataaaagacttttggagc

SEQ ID NO: 381032 - DNA, 477 bp, Homo sapiens
tctcccctatatagtgacttcactgagtctaagtaaagttgtttgcccagccaatagaaagcagaattgttagaattaaaggggtctatagaataaaatgggtttgtctggctctaaagccaccactggacttagaaagctcagaggttctttaaaatgaacacttctttcccaggatttgcagaaattccacattttgagttctaagggaatggtatgggctcctccctgggcagaatcatagtgcataacttggactacagttgactttccaaacgagaagttgtactggggggctagggaggttactgcgacaccttactcttaaggaattaagacctaaaactgttgcttgttcatcatcataactggcgagtagttgaaactttatctgaggatttttaaatttcttgtaaaaaaccaagtaactaaattactattttgttgtgttttcttaaggtgttgggctggatcttg

SEQ ID NO: 381033 - DNA, 556 bp, Homo sapiens
actttgctgatttagcttatggaagaggaaccagaaatttgtccttgaataatgtttcccgtgttgggctggatcttgatagcagttgttatcatcattcttctgatttttacatctgtcacccgatgcctatctccagttagttttctgcagctgaaattctggaaaatctatttggaacaggagcagcagatccttaaaagtaaagccacagagcatgcaactgaattggcaaaagagaatattaaatgtttctttgagggctcgcatccaaaagaatataacactccaagcatgaaagagtggcagcaaatttcatcactgtatactttcaatccgaagggccagtactacagcatgttgcacaaatatgtcaacagaaaagagaagactcacagtatcaggtctactgaaggagatacggtgattcctgttcttggctttgtagattcatctggtataaacagcactcctgagttatgaccttttgaatgagtagaaaaaaaaattgttttgaattattgctttattaaaaaataaacattggtattttttg

SEQ ID NO: 381034 - DNA, 430 bp, Homo sapiens
aaattatatattgataagtaaatggcttgttgcatataccaactttagaatttattaactctaaagtttttattggttaaagccaaataaaataatataagctcatatttttttagatttttcatgtcctaaaatgaacatagttgtatactttatctcactaggataatttttatctttgcctatatgtgctgctggaccttgtaaaaatatgtatactttctagatttgtggtagaaatttagctatagaatcatttaatttgcaaactgggaatggggcattagagaatcatacagtttttctttctcattttaccggtaaaatcactgatgtctcaatttgtgactaatttcctaaaggttgcaaagctgagtagatagagctagaactaaatctagatcttttgtcttcttggtaactgataatg

SEQ ID NO: 381035 - DNA, 457 bp, Homo sapiens
cactgccccaccctcattcccagctccaaccttcaggcaggagttagaaagatcctagtatgttgaaactgaatggcacaacaataaagtagttcactacctgaccacccagcaatgatattcactagtcaacaagttctatccatgggacacagagctttgaaatgctttctagggttcaggggtataccaggtattagaggaaagcctccaacaacaacaaatcagacactaaaacaaataggagaggaaaatcctatcgagagatagaaacagccaggcacagtggctcacacctgtaatctcacacctgtaatcccaaggttcaaatgccattttgggaagctgaggcaggtggatcacttgatcctagaagttcgagaccagcctgggtaatatggcaatacctagtctctacaaataataataataaaaaaagccaaaaaaaaaacccaaa

SEQ ID NO: 381036 - DNA, 578 bp, Homo sapiens
atacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccagatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaacacaacaaaaaaaaaaacccgagcaaaaaaacaagacacaacaaggcaaaacacaaaaagaaacaacacaaaagcaaacaacgacaacacacaaaacaacgaacaacacaaaggggggcgggcccaaagaac

SEQ ID NO: 381037 - DNA, 1040 bp, Homo sapiens
tctttgtcctggttgggaccgggctgtgatggggacctgatgaaagatggtgagaagggcaggtactgggccctggagagtgggagagggcagaagacaggaggagtggcccattcccaggcgtagcttgtgatttaacacccactgggggcttctggtagtcagctcctccgtcgggaagttctgtgggaaagagatgatggcaggggagcagtgggggatccccaggggccatggctgcacagaccctttgttcctccacctcgaactgtacaggtggggaaacggacctgagagggaatgggagttgtccaaggtcaccctccctgctgtgccgtggcagcaccaggtctgggacccaggcctgccaatgcgccatgcactttgcacccaactggtggcctcctgggagtgggagtctggctgggccatgtgctctcagcctgggcttttgtttgggccctgctctgggctgagctagggcttggcctccctgactggccctgggcagcccctcactccttggtccccacagccctgtacttcccccatctctgcatatatgaccctgcacagttatgacttggtgcttgtctgtctctctcactagaccatgatctcatttttctctgtttccccagcctcccaccctcagagggctcaggactgtgtatggtcaaggaatatttaccaaagaagtgaggccacctgttccccctcccccaacctgtgaaaaggaagcaaccatccctcctgccctgcagcccaggaatgaagctgcaaagttctgatagtgcctgccatgagatgttacagcacagagcagtggggcttttggacagctgggaaagaggagtggcataagcgccccacctagactgcccaataattagggataaagctgacaccgtgggaaaagcctagagtttgcctggcactaacagatctaactcagactttgtaggtggggtgacctcaggactctttaagcctcgggttcctcatctgtaaaatgggagtaatcaggatgtatctcatag

SEQ ID NO: 381038 - DNA, 2374 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381039 - DNA, 2326 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacatgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381040 - DNA, 2172 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccggtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381041 - DNA, 2270 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgatccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381042 - DNA, 2252 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaataatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381043 - DNA, 1598 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381044 - DNA, 1332 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381045 - DNA, 1339 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccacagccgatactagaattccaacgtagtccatgagtttccaccgtcgcat

SEQ ID NO: 381046 - DNA, 990 bp, Homo sapiens
gctagaggtggcctggcctcctctcttcccaccccacctctagccactggacatactaccttttgtgcaactaagctaaacagaggatttccaagggtgataactggggactggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381047 - DNA, 854 bp, Homo sapiens
agaggatccccactatcatgtggtctatgagggctggtttgccacctgagaattgccacaggtgcactgcgcgtggcctgctcccgataccacgtgttccagttgcccacgagtgagcatgggtagtcctcatccaggtgaagcttggatgaggactgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381048 - DNA, 747 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgcctcccaccctcagagggctcaggactgtgtatggtcaaggaatatttaccaaagaatttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccg

SEQ ID NO: 381049 - DNA, 642 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccggtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381050 - DNA, 558 bp, Homo sapiens
  misc_feature (125)..(125): n is a, c, g, or t
agccacagcccagaatgggtcccaacatctatgagctgaggacatacaagctcaagcaggaccaggcagtgcacctgtggcgattctcaggtggctacccagccctcatggactgcatgaacaanctcaaaaacaataaggagtactccgctccctctttgttcacaaagtggatccccggaaggatgcccactccaccctgctgtccaagaaggaaaccagcaacctctataagatccagtaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381051 - DNA, 555 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgcctcccaccctcagagggctcaggactgtgtatggtcaaggaatatttaccaaagaagtgaggccacctgttccccctcccccaacctgtgaaaaggaagcaaccatccctcctgccctgcagcccaggaatgaagctgcaaagttctgatagtgcctgccatgagatgttacagcacagagcagtggggcttttggacagctgggaaagaggagtggcataagcgccccacctagactgcccaataattagggataaagctgacaccgtgggaaaagcctagagtttgcctggcactaacagatctaactcagactttgtaggtggggtgacctcaggactctttaagcctcgggttcctcatctgtaaaatgggagtaatcaggatgtatctcatag

SEQ ID NO: 381052 - DNA, 584 bp, Homo sapiens
ctaaaaatgctgacacaccaaagtagagatgtcaagtaggcagtagatggatataggagtctggagcccttgggagtgtttgcgactagaaatataaatgtaggcaatattaacatatgtactgattggatggatgattaaagcagacagtgtttgctaatagtctgagggaggcatctagggaggaggagacagcagtgcagggtttaggggacagtgggaagagggccctgtgctgggtaagggatccagtcctctgtgcctgaggaatgagcctgtgcctttctcacagcctataaagacctgcagtctcgggaggagactcgaaacgctgcctggaggaagagaggctgggatgaaaatgtctactatacaggtgagtgaagcctttggaggtcttctgctgagaaccctgtctgaggatggaatcctctctgcaaggagatctagtctttcttgattacctccagtgatggggaactcacttttaagacaatgagttaatgggtttctatccaagtggcacactccataggataccagcaggcctaggtgagtactctaggggatgataacatagccag

SEQ ID NO: 381053 - DNA, 686 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccggtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccg

SEQ ID NO: 381054 - DNA, 2176 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381055 - DNA, 2718 bp, Homo sapiens
tctttgtcctggttgggaccgggctgtgatggggacctgatgaaagatggtgagaagggcaggtactgggccctggagagtgggagagggcagaagacaggaggagtggcccattcccaggcgtagcttgtgatttaacacccactgggggcttctggtagtcagctcctccgtcgggaagttctgtgggaaagagatgatggcaggggagcagtgggggatccccaggggccatggctgcacagaccctttgttcctccacctcgaactgtacaggtggggaaacggacctgagagggaatgggagttgtccaaggtcaccctccctgctgtgccgtggcagcaccaggtctgggacccaggcctgccaatgcgccatgcactttgcacccaactggtggcctcctgggagtgggagtctggctgggccatgtgctctcagcctgggcttttgtttgggccctgctctgggctgagctagggcttggcctccctgactggccctgggcagcccctcactccttggtccccacagccctgtacttcccccatctctgcatatatgaccctgcacagttatgacttggtgcttgtctgtctctctcactagaccatgatctcatttttctctgtttccccagcctcccaccctcagagggctcaggactgtgtatggtcaaggaatatttaccaaagaatttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381056 - DNA, 2174 bp, Homo sapiens
aattcggcacgaggttgctttgagggaagttacgcttattttttttttttcctttttctggagaacggggtctcgctatattgcccaggcaggtctcgaactcctgggctcaagctatcctcccgcctcttagcctccctgagagctgggattacaggcgtgagctcgtgccgaattcggcacgagtccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381057 - DNA, 2096 bp, Homo sapiens
cgcggacgaacaactacgtgctaggtacgaggccgggtgttaatcggccgaggccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagcccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381058 - DNA, 1634 bp, Homo sapiens
  misc_feature (125)..(125): n is a, c, g, or t
agccacagcccagaatgggtcccaacatctatgagctgaggacatacaagctcaagcaggaccaggcagtgcacctgtggcgattctcaggtggctacccagccctcatggactgcatgaacaanctcaaaaacaataaggagtactccgctccctctttgttcacaaagtggatccccggaaggatgcccactccaccctgctgtccaagaaggaaaccagcaacctctataagatccagtttcacaatgtaaagcctgaatacctggaggaagagaggctgggatgaaaatgtctactatacagtccccctggtgcgacacatggagtctaggatcatgatccccttgaagatctcgcctctgcagtgatgctgcctacacctccacctccttccccttctccctcaggcaaccccgacagacagtggcactcctggtcctgctgtcttggttttgtcttggctctgggaggactctgaggggcagtgctcagttcagacaagggggaactgaaggctgacaagttctgaggattacagctctgcccaggccctttctactttccctgcctgcctccctccccctgctagaagtagtttctgatttccctgaatgaaagatagtgatcttttaggccttcatatatcttctaaaattcctcatctcaaggccaccagtccccagttatcacccttggaaatcctctgtttagcttagttgcacaaaaggtagtatgtccagtggctagaggtggggtgggaagagaggaggccaggccaggccctcaggaattccctggtttccactgggccacccacttgctggacagtctgagccaagtccctcctgctggagaaaagcctggaactgccaaaacaaaaaaacaaatacaaacaaacctcgtcaccacggtcaggaggaggttcagacattctgcccagaggggctggggaaagggatgggagccaggaaagatttaggggcaggagacagacacgtaacaggaactcggaaggtagaacttagaattcagaacttgggtttcaattgtagaatttggaatctggaatacagaattgggaagaagaacagagatgacaaaagaccacttgaagagaggttcctaatactagacagatggagagtggcttggctgtttccccctgcatattggggttgaaaacttaaatgtgtagttccagtccttctatgcagagtctctcctgccctccctccttcctgcaggcaaatatacaagctagaccctgttccctcaccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381059 - DNA, 1455 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggagtacctggagttccgaagggagcggagccagatgctgctgtccaggagaaaccagctgctcctcgagttcagcttctggaatgagccacagcccagaatgggtcccaacatctatgagctgaggacatacaagctcaagccaggaaccatgatcgagtgggggaacaactgggctcgggccatcaagtaccggcaggagaaccaggaggcagtgggcggcttcttctcacagataggagagctctacgtggtgcaccatctctgggcctataaagacctgcagtctcgggaggagactcgaaacgctgcctggaggaagagaggctgggatgaaaatgtctactatacagtccccctggtgcgacacatggagtctaggatcatgatccccttgaagatctcgccctgtatcctgtctcccctaattgacattctatcagcccaaccctcattctgcagggccacctggtgtgtggaggtggcgggaggggtcagtgactctgggggtctcctcagtgacccccatacctcatcatgaacccttgggtagcttgattctgcctaccatccaggaaaacttgtgctggaattgctgatggaaacaattaaatattttactataaaaaaaaaaaaggggggcgccaaaatttccctcagggcgccatttgcgtacccgttctgacaaggggccatatggagcgttaaaaaagaggccggtaaaggcgggaaactctggtcttgaagacctctggggacaag

SEQ ID NO: 381060 - DNA, 1087 bp, Homo sapiens
tcccacgctcccattttaccgaggtggatcctgaggcccagagtgggcaaagggcttgccaaggtcgcagagcgcgcagaggattagaaccctgacttccgtccagcacctgcggagttggagacgcccacaggaaacgcccacctgaccgggtgagtgagggggcgggcgagccggaggggtggagtttattcgcgccccgctccgccaccagggcttgggggcggggccttcctgcaacctttgcggctccaacatggctccgcggctgtgcagcatctctgtgacggcgcggcggctgctggggggcccggggcctcgcgctggggacgttgcgtctgcagctgcggcgcgtttctattccaaggacaatgaaggcagctggttccgctccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtatggggagcaggaccaggcagtgcacctgtggcgattctcaggtggctacccagccctcatggactgcatgaacaagctcaaaaacaataaggtatgttagtgtccactcagcacacctctctggatgtgggatgcagcccagccctgttctggggactactctgctaccccatgaggcacactgtcaggatggagcgcacttcctggtagccatgcctttaccaccatgcccacaggactccctctttgttcacaaagtggatccccggaaggatgcccactccaccctgctgtccaagaaggaaaccagcaacctctataagatccagtttcacaatgtaaagcctgaatacctggatgcctacaacagcctcacggaggctgtgctgcccaagcttcacctggatgaggactacccatgctcactcgtgggcaactggaacacgtggtcctgctcttccagggcccttccccggcggccgct

SEQ ID NO: 381061 - DNA, 352 bp, Homo sapiens
ggaggctgtgctgcccaagcttcacctggatgaggactacccatgctcactcgtgggcaactggaacacgtggtatggggagcaggaccaggcaggtaaggcgctcacctccctagtgccattgccactgcccagccctggcctccagcacctttcacacctggctgttctccactccctctccacaacagcacctggtggggctcttactaaaacctcatcacctcactcccctgctcaaatacctgtcctggctcccctgtgccctcaaggtgacccgtgaagcctgtgactccttcccggccctgcccccagcctcatggcaccaaatcctccatgcctcgctgtgctg

SEQ ID NO: 381062 - DNA, 401 bp, Homo sapiens
gactgctttaggtcgggcgtggtggctcatacctgtaatcccagcaccttgagaggcggaggcaggtggatcacctgaggtcaggagttcatgaccagcctggccaacaatggtaaaacctcgtgtgtattaaaaataccaaatgagttgggcgtggtggtgtgcacctgtaatcccagctacttgggagtctgaggcaggagaatcacttgaacctgggaggtggaggttgcagtgagccaagatggtgccattgcactccagcctggacaaaaagagcaaaactgcatctcaaacaataaataaataaataaataaataaataaagactgttatatatgacattctttgacacctaatcaaagatatatggttaagcttatgcttatttagacctttct

SEQ ID NO: 381063 - DNA, 335 bp, Homo sapiens
ctatattcctgtgtaaattattaaatcctaaacataatccaggtataccggcaatttaagcacctgttgctggctctcctgattttggtcagggtaattgaatcatgtgacaaacaggaactcttgaaggcactgcaggtttggactaagatacaaaataaaatcaagtaaataagctttattttaagtaaacaacagcaataacaataataaaactgcctgagaattcaaaagaagggcctggcacagtgactactcacacctgtaatcacacactttggaggccaaggcaggaggattacttgaggccaagtgtttgagaccagcctaggcaa

SEQ ID NO: 381064 - DNA, 467 bp, Homo sapiens
ctctgcccttccaactaggtctcaaaggagaaaagagctctcacctgggagtcagggagtctggcttccagtcctgcctctgaccctcacaaccctcttaagcactaacattcaagatgtttttaccaaggacctcatccaaagagacaatatccaaggagagtaagaacaccagctttacctgcctcacaggatggtgggaaaggtctaactacatgttgttccccaaagcattttaaaaaccatagagggctggctgttgacatgtcagtttctcttaccatagagtgggatcgccaactgtcgccggaaaagactgtggactttctcaagctgtgaatcaaagaaacaagatattggaggaaactgggtgaagggagtacacaagacttctctgtactatttctgcaacttcctatgactctataattacttcaaaataaaaaggttttcttttaatgttttaa

SEQ ID NO: 381065 - DNA, 431 bp, Homo sapiens
tctccttcccgagtgctgctatgcactgtaacttcagataacccttccaagttcagcacaccttgtacgtgctgcagaagtagaaagaaagaaggaaaaagacagatggaccagtataaatccagcaaataaaccaagaggtggatgggacacagggccagcagcccaggtgcccagggaagtgctgtacctgaacacctataggaagaaggaagacagagaaaaaccatgattcgaggcatgacccagctcacctgactcctctgacaccagccttgtccccatgagcagcccagccaggcagactagagccaagccatgctctgaaacttgttaatggggccaccggagcgagtcacttaacctctccaggcctccatgtcttcctctgtaaaacggcaagaataaaagtaaccattcacagagtctca

SEQ ID NO: 381066 - DNA, 3549 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtcctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctg

SEQ ID NO: 381067 - DNA, 3270 bp, Homo sapiens
ttgcatatgggcaaggccaaggtcagaagatgaaccacgtgacgaaatagaaaaagctacctatggagttgtgcttggccttgccatattgcaagcattatggcaaggccaaggcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtcctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctg

SEQ ID NO: 381068 - DNA, 701 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagggaagtgctgtacctgaacacctataggaagaaggaagacagagaaaaaccatgattcgaggcatgacccagctcacctgactcctctgacaccagccttgtccccatgagcagcccagccaggcagactagagccaagccatgctctgaaacttgttaatggggccaccggagcgagtcacttaacctctccaggcctccatgtcttcctctgtaaaacggcaagaataaaagtaaccattcacagagtctca

SEQ ID NO: 381069 - DNA, 382 bp, Homo sapiens
tgatgtggtccccaattcacatggagaaaatatttaagacaattatactatatacaagggacggtaaagagacttaaagggaggtgagtcttctatacttcacttgcactggtaagatgtcaataccagcaggcgagggaggtctctgtggggacagaacagctctgtatctggactgcagcagtggttagatgaatctacacatgtaataaaatgtcttttttttcccattgttccaaggtcaatttcctggttttgattttgtattacagaaacaagatattggaggaaactgggtgaagggagtacacaagacttctctgtactatttctgcaacttcctatgactctataattacttcaaaataaaaaggttttcttt

SEQ ID NO: 381070 - DNA, 3603 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtcctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctg

SEQ ID NO: 381071 - DNA, 2363 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctg

SEQ ID NO: 381072 - DNA, 568 bp, Homo sapiens
gaggccggcggagaaggaggacccgggagccggcggcccggagctgggagcgcggggaaggcggttggggttctgacagctgcgcgcgatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccagaaacaagatattggaggaaactgggtgaagggagtacacaagacttctctgtactatttctgcaacttcctatgactctataattacttcaaaataaaaaggttttcttttaatgttttaa

SEQ ID NO: 381073 - DNA, 328 bp, Homo sapiens
caacttcaaggcctattggtcagtaaaatcagctaataagagtggagggagtgggggaatgtccagaaaatttaaggaaggaatcaactaatttcaagttggaagggttttacggactcatgatctcacagagtctaaaggaccttaggaacttccttgtccagcctcacaccaaacgcaagacggccatagatcttcaccccttttttgtgaggctctggttaggggtaggaaatcatctagattccttagatcttctctaattctctgagtccatcacatcatcctataatattggatgaggaaatcaggcaatgatctctgattt

SEQ ID NO: 381074 - DNA, 505 bp, Homo sapiens
agttcattagctgacactataccttttatttccaattagtcttctacttcatcaattcatatatcttctctctggctacccaaatgctgccatgcagcagggattctcctctaaacagcagaagagacgtgcctggagaccagagccagtgcctcaacagaaagtcaagtctgtctttccagttctgggcttacagcagattccatatcctctgatcttctgtggcagtctcattctccctcttccttctgtcatagaatctctccaaataagatttaaacatctggaactcccaagctgcgcttcccaaaaggaccccgtgacccatggttaattgtaatacccatccaatagccatctaccacgaagggctgcaaccctactttaactttagacagtttttttgttgtcattgttttttgttagtttgagtcagagtctctctctgtcactccagcataccaacagaggaagacattatatcaaaaaataaaataataaaata

SEQ ID NO: 381075 - DNA, 455 bp, Homo sapiens
ggtggatcacctgaggtcaggagttcaggaccagcctggccaacatggtgaaaccccgtctctactaaaattacaaaaattagctggcccaccattttaaacagagaaccaattccccattttttgtatccatttgctttatcttttttatatcttagaatatcaacctagaagctaggcacagtggctcacacctataatctcagcacttttggaggccaaggcaggaaggattgcttgaggacaggagttcgagaccagtgtgagcaaaatatggagaccttgtctctacaaaaaataaaatagttgtgggtgtggtggtaccagatgtggtggtacacacctgtgtagttccagctacccgacaggctgaggcgggaagagctcttgagcccaggagttcaaggctacagtgagctatgattgcaccactgcactttagcctgggtaacaga

SEQ ID NO: 381076 - DNA, 491 bp, Homo sapiens
cacagggcatcagccacatcaagagacatcccaggatgctccaaagatgtgagtagtccaaacccaaagtaagatagaattactccaggtaaggcttagtttcccaaagtgcacaggatgattccactgagagagatatacaggtctttctagatggtcacaatttttttttttttttgagacagagtctcactctgtgtcacaggctgtagtgcagtggcaggatctcggctcactgcaacctctgcctcccaggctcaagcgattctcctgcctcagcctcctgagtagctgggactataggtctgcaccatcacacccagttaatttttgtgcttttaatgcagatgggatttcgccatgttggccaggctggtctggtactcctgacctcaaagtgatccacctgccttggcttcccaaagtgctgggcttataggcatgagccactgcagatggtcacagattcttgaaccagaaccttagcccta

SEQ ID NO: 381077 - DNA, 835 bp, Homo sapiens
gatcatgccactgcactctagcctgggcgacagagcaagacttcgtctcaaaacaacaacaaaaattatggttatgtcaggtacagtggctcacacctgtaatcccagcactttgggaggccaagatgggaggatcacttgaggctaagagtttgagatcagtctagaaaacatagtgagattccatctctacaaaaagtttaaaaattagctgggtgtggtaggtacatgcctgtagtcccagctacgtgggaggttaaggtgagaggatcacttgagcctaggagtttgaggctgcagtgagatgtgatcacaccactgcactccagcctgggcaacagagcaagaccttgtctcaaaataaataaatgaaagaaaagaaaatttatggttacaaatggttcatcattttagtttgtcacatataaatatcttctattcttttggttcttgtccgctgccagcccccgcattcctggatcaattttacagtctgccttctctgtttctgcctgtgccttaaaaactgagtgctataaagttatggaattgctgcctctctaagctcatgtctctaaattccaatctcatttgagttctctttaccagtcaccatttttttttttaattttacgttggttggttccctttgccttttccttcagcagctgttacagacttctactcatctcagaccccttcctaatctctgtctcattgtcatacaacccaccttggatctgggacaccaaaaagtttaggctttctcttgtgaactctttcaacttccttctgactttctcattacatgtctctgtttgacctcatttttacc

SEQ ID NO: 381078 - DNA, 296 bp, Homo sapiens
gtttcagcactgttgaaaagactcttctttccctgttgaattttcatgacctctttgctgaaaatcaatttaccataaatgttagtgtttatttctggactgtcggttctatgccattgatctacatgactgtccttatgccagcactgtgctgtcttgattattgtagctttggagtaagttttgacatcggaaagagtgagtcctccaacgatgtttgtcattttcaagattattttggctgttctgggtttatgatctgcttgtcaattactgaaaaaaaaaaggctaggctt

SEQ ID NO: 381079 - DNA, 427 bp, Homo sapiens
gtgctaggcagtgaacacagggtatgaacttgaaaatctgattgcaccctcaatatctggaatatacactgatctatgacctgaaattgtatggactgcagcaatccaaggggacactaagcagggtttgagtaatgctacaatggatttataggtcattttggagaaggtgttccacatcattagggagtctgggtttcccagatgtgcctgttttatcctttttattttaaataacatcactgtctttcctaactaaaaattcttcatcttcaggaaataagattgagatacggactgaaaatataaaattagcaataatgtttattattagatacttcctcaattaaatttctccctgaaagtcttagggcaaaagcccctgtctcttacttcatatatcaagtttggagggaaagacataatt

SEQ ID NO: 381080 - DNA, 770 bp, Homo sapiens
tatattaatgccagatatagtatatttcagaacaaataaactaatcagagacagagagggagactatataatgtgcaaaggaccaatccaccaactcctcgcctgacaaattcataaatgtctacgcaagaacaactgaaagtacttaacagagaactagacaaatccacaaatacagctgtatgcttcaatgtccccctttctcaacaatttatacaacaaccagatagaaaatcagcaagaatacagaagaacccaacaacacgatcaaccagcgggacttaaattggcaattttagaacacccaaccacaccagaatacacattgttatgggatgcattgtgcccagcccccccaaattcatatgttgaaatcagaacattattagccactagtgatttactaattaaaacaatgagaaattgctacgtacctatcagaatggccaacataaaagtgtgaccacatcaagtgctgtcaaggattcagagaaagctggatcactcatacattgctggtggggatgtaaaagattacagcccactctggagaatatctgtataatttttacttttaaaactctatgtgcaactaccataccacctcggaattacattccctgcatttatcacagagaaatagaatcttatgttcacacaaaacccatgtacttcaagtttatagcagccttgtttttaatagccaaaactggggaaacaatgtatacacgacttttgtgagatgaatggttaaactgtggtatatatcc

SEQ ID NO: 381081 - DNA, 400 bp, Homo sapiens
tgaccagggcacgtcacttgacctctctgatcctcagttccctcatctgtaaggtgctcataacaatggttctaagggtcctggtctcagaaggtgttgggaagatggggcaaaataacccccagaaggcacttagcacagtgcctggcaacttaaaaatgatcagtttctattattgctatttccaaagtcgggcaaatttgcagtgatctctgagggagaaataggggtaaggtggggcaagagacagcacatgcaaaggccctggggtgggatgttggaactgaaagtgaagagtatggcataaggcaggaccagagatggggactggggcctgagagccaggagaagtcagcgttgggggatggacggatcctctgtgacttctcctggccacctt

SEQ ID NO: 381082 - DNA, 428 bp, Homo sapiens
actctccttgaccccagagtccactctgggatggaagaacttgaaggtggggcaggatgcaggggtgtgggcgcaagggacacccaagaaacagccaggtgatggctctcagcggccacacgcagaaactgatgacaaagaatcggtttaaaaataagaaggccaggggcaggggctcacgcctgtgaccccagcactgtgggaggccaaggtgggtgatcacttggggctagatgttcaggatgagcctgaacatagcgagaccccatctctacaaaaaatttaaaaatcagccaggcgtggtggtgcacacccagctacttagaggctgaggcaggaggattccttgagcacaggagatcgaggctgcagtgagcccagactgcaccactgtactccagccagggacagagtgagaccctgtctca

SEQ ID NO: 381083 - DNA, 407 bp, Homo sapiens
tctagaatacgcctcataatattaaaatattttgtgtatgagatcagagctggagtcccggtcaactgtggagaatggccaattccagcctccaaaataaaggcgggggtggcggtgttggggggggggaggggagtcgcgcagcagagaaaagacgtaagggtggagagggactttcaaaatgccccagtgccacggttaactataacctggttaataaaatctaagccaatgctctcaagacgaggagggccacaggcaggggaaaccgagaattaactcataggctgagactaagttattccactttccatgtaacagcgccccccacaactccccgtctgccccagagttaagattccaaggggcagccccccctcctcaaacacactaaagaagggacacca

SEQ ID NO: 381084 - DNA, 1123 bp, Homo sapiens
caacggggtttcggggctgtggaccctgtgccaggaaaggaagggcgcactcctgcaatgcggaagcacagggcagtgggcaccaggctttagctccctttctcaccctacagagggcaggcccttcagctccattctcctccaaggctgcagagggggcaggaattgggggtgacaggagagctgtaaggtctccagtgggtcattctgggcccagagatgggtgctgaagctcccacgcctgcctgtgaaaatggagtcctctctcacctgggagagccaggtgctgccccgagaaggatgcatttatggcttcgtgaagtctttcctgacccccgatgctgcttgactatagagacaaagtctcactatgttgctcaggctggtcttgaactcctggcctcaagcgatcctcccacctcagcctcccaaagtgttgggattatagacatgagccactgcacctggccgaccttgggcaagttcttaaacccttcaaagcctcatttttctccaatcacaaaagggaaagatggtaatattttccccaccaaattcttgtcggatgccctcacagaattgagattatgtacgtaaaacaccaggtgcctaacccggcacagagcaggagggctaagcgtgacatccaggcacgtggtcagtggaatccagtattcctacccacctctctagtctcccctccacccctctccctttcagaggcaccaagctgcttgtggtcttgtctattcccactccctgcctgactgaacattttctccacctcctgatcatcagcagcagaaactggctgctcttcctcctgggtagacagccagactgtatttcccagctgcccctgcagtgagatgtggccatcggagccagcattggccaatggactctgcatgggagtgacgcatgctgcctccaggcttgtccctaaaacctcccacgtgtcctccgcctgctcttcccacctccaaggagcacggcaattgtggaagacccagattagtgatggcagaaccatagatgggaggaacctgggtccctgacttaaagtatcatggatttggatgttcccttagtgagaaataaacttccattgtgtttaagcctt

SEQ ID NO: 381085 - DNA, 386 bp, Homo sapiens
acctggggcaaacaggtgaacttctccaaacctcaatctcctgttctgtgaagtggaggtggggaggggacttccggaacactgttgacttgactggctcgcaatcacagcgagtgttcacaacgtgctccccgtgtcccaggcacacttccgagtgcttgattaccttacgagtggctgcagccgtgtgctggcccacaagagccaactgttaaatgttctgaaatgtggtgaatggttgttaaaacacaggtagcttgaaatcagccataaggaaaatatttggacgacaggaattggcagatatgacacattaggacttgttgctgttgttgttgttgttttgagacccagcctgggcaacagggcgagactcagactcaaaa

SEQ ID NO: 381086 - DNA, 373 bp, Homo sapiens
ggactaaacaatggaaatggatttgaacaaaattgtgctggtttaggccgaaggaaagagaaaacagcattcacttgtaattctagtataaatgtgagaacaggtcagcagaagtggtgggtgaatctgtatcactagagatccttagtagcttaaatagacaactgctagttttaaattgcttaaggttcctctttttctggtcagcagcctggactaagtaacatttgaaatatattttcagttctgtagttatgtaaataattggacttttctgaaagccttttaacgtgcaaatctcccaagtcctgagttggaaaaagcccaaaacaaatactctcccctccccctacaaaacctaatttctgccaaa

SEQ ID NO: 381087 - DNA, 1633 bp, Homo sapiens
gggtatattttatttgcctatggccagacatttaggaaggcaaactggagcaagaggaaaagcaggaaaaaatagactgataaccaaaatgtaaaatatttctgtgttgatcatcagggaagtgaataacacaggccacaaagacccctttttttcccacagaacttttcaacagatggttatactagttgtttcagaattaataccaaggattgagggttggaggcatgcaacttagaagcagtgctggtgtgaaagtgataaggtttttggctccaagtaacacctcccaatttgtacagcaaccacaatagaaatgtgcttcaggcaaggtggcgtcctacattttaacttacccccaagaaaatatcctgaatttcacaggtgttctcagtaatatgacctgactgaaaatagcttctcttctgtatttttccccaggttaaaattaagctcggcaggctcgacgtaaatgtgcagacaaagcaaagcaggaagcctcccacactaaaaagggaagataagaatcacagaagctgggatggtttttattgaagggcatttcaaagcaaatacagacatctacagcatatttgtaaatcctccgtatgtgtatggaaacacacaccttcacacatcaaaactggatttgttcctgagtaacaaaacgtcctaagaacaaaatgaaagaaaaccaaatagcagaaaaatacttccaatgtatataccacaaaggattatttatcaactcaacacaccaagagttaagaaaataatgcaacaggaacaaagggcaaaggatatgtactgggaagaccacagagaaagaaaatgcaaatggctaataatataaaatatttcctaggttcaatagtaatcagggaaagacaaaattacacttttgacctcttagactggcagtgacaaagattatttgagtgaccaagctttagtcaggctcctggatcttctaggcccatctgggcacttcctcgtaaaatacagttttaacaaaagccctgctaaattggtttaccgagaactcccaccctcaatcgagttccttagcccttcacctttcctcaggtgagggctgatcatcctgtcctgtcttcagcaagactgctctaacgctgacgtttccttttagtaattttccatccactgacacccacttgtaatttatagccaaggagcaagatacactgctccttggctataagttattttccctgttacattcagagttgagcccaatcccactccccgactacaaaatcgatagcagtggtccctatacctattgcaatggtcctaaataaaacctgccttaccgtgcttgaacaagtgtcatcgaataattttttaacagcaaattgttggaggtaaagacatttttaaatgtcttcaattagtttagctacttccacgtaatgttaaaatctccatcaattggctagttactgtcccttcctgagaagaagcagacaccatagccctgcatactgtggattcactcctaagttgatattgatatgaatgaaatagttatctcccaaactttgctttctacatttgtatcaaaaaacatgatgcccctctgcccagcgcccccgccactggatccccagtc

SEQ ID NO: 381088 - DNA, 1579 bp, Homo sapiens
gggtatattttatttgcctatggccagacatttaggaaggcaaactggagcaagaggaaaagcaggaaaaaatagactgataaccaaaatgtaaaatatttctgtgttgatcatcagggaagtgaataacacaggccacaaagacccctttttttcccacagaacttttcaacagatggttatactagttgtttcagaattaataccaaggattgagggttggaggcatgcaacttagaagcagtgctggtgtgaaagtgataaggtttttggctccaagtaacacctcccaatttgtacagcaaccacaatagaaatgtgcttcaggcaaggtggcgtcctacattttaacttacccccaagaaaatatcctgaatttcacaggtgttctcagtaatatgacctgactgaaaatagcttctcttctgtatttttccccaggttaaaattaagctcggcaggctcgacgtaaatgtgcagacaaagcaaagcaggaagcctcccacactaaaaagggaagataagaatcacagaagctgggatggtttttattgaagggcatttcaaagcaaatacagacatctacagcatatttgtaaatcctccgtatgtgtatggaaacacacaccttcacacatcaaaactggatttgttcctgagtaacaaaacgtcctaagaacaaaatgaaagaaaaccaaatagcagaaaaatacttccaatgtatataccacaaaggattatttatcaactcaacacaccaagagttaagaaaataatgcaacaggaacaaagggcaaaggatatgtactgggaagaccacagagaaagaaaatgcaaatggctaataatgacctcttagactggcagtgacaaagattatttgagtgaccaagctttagtcaggctcctggatcttctaggcccatctgggcacttcctcgtaaaatacagttttaacaaaagccctgctaaattggtttaccgagaactcccaccctcaatcgagttccttagcccttcacctttcctcaggtgagggctgatcatcctgtcctgtcttcagcaagactgctctaacgctgacgtttccttttagtaattttccatccactgacacccacttgtaatttatagccaaggagcaagatacactgctccttggctataagttattttccctgttacattcagagttgagcccaatcccactccccgactacaaaatcgatagcagtggtccctatacctattgcaatggtcctaaataaaacctgccttaccgtgcttgaacaagtgtcatcgaataattttttaacagcaaattgttggaggtaaagacatttttaaatgtcttcaattagtttagctacttccacgtaatgttaaaatctccatcaattggctagttactgtcccttcctgagaagaagcagacaccatagccctgcatactgtggattcactcctaagttgatattgatatgaatgaaatagttatctcccaaactttgctttctacatttgtatcaaaaaacatgatgcccctctgcccagcgcccccgccactggatccccagtc

SEQ ID NO: 381089 - DNA, 495 bp, Homo sapiens
tgaacttggaggacatcatgctatttgaaatcagtcagggacagaaagacaaatattgcatgatctcacttatatgtggaatattaaaaggttgaactcatagaagaggagagtgggcctaggttgccagcagctgaagggtggtgggaggcactgggggagatgttggttaaaggatacaaagtttcttttagactggatgaataaattctagagatctaatgtaagtctagttacattagagtatagttaataatgtaatgtatacttaaaaactgcagagattagatctcaaacgttctcaccacacacacaaaaaagatatgtgaggtaatggctatgttaattttgtttgatttaatcatttgacaatgtatacctatatcaaaacgtattgtattctgtaaatatatataattttaattgattaattatgccttaataaagctgaacaaaatatataaactagtaaaacaatttacttaccataattca

SEQ ID NO: 381090 - DNA, 508 bp, Homo sapiens
gtctttttaccatgcttgtgtgagatcattattccatggacgcttatggcattagactgaattgattttatagagaaaaagaactcaagattgcataagcccatattagcagcaaattcctaatatctaagtttctttctgtcttaaaatagatgaatttttccatttcgatgaaaggttttggatgaaaagattttgcagtctttatagagcagcaatcactgagtgctacaaaatattttattacatttttttgccttgaattttgcattatgggtaaagaactgtgtgacttaaaatagcttaccaatcttttaggaagttagaaaatatttcattgttgttgatttagagactgagtcttgttctgttgcccagtttggaatgcagtggtatgatcatggctcactgtagcctcaagttcctgggctcaggagatccctcctgcttcagcctctcctgtagctgggactataggcacttgccaacatgactggctaattaaaaa

SEQ ID NO: 381091 - DNA, 440 bp, Homo sapiens
cttcttgttaaaccccccaggtctttacaccattgttaacaacaatcactgagtctcattgaacactcactgtagtccaggtactgtgaggaaggctttctttttgtgctttaaattattttttcccatttatgattgacagaaaggttatgcgtcttgcctgaggtcacacagctagtgtatggccaacagaactgcaatcctggaggggtgtgattccaaagacagagtttctcattactgtttggcatcatttctacttatggtgattttcactgttttaacagtttagaatcccttatgtcactttcataataaaagggagaaaagggcaaatactttgtcacagaaagaagattcattaaagggatatttttaagccactgttttcacaagaaaaccaaatgctagaaaaggtacaatgctaaaaagaaactgta

SEQ ID NO: 381092 - DNA, 528 bp, Homo sapiens
tgatcgtctggcctcagcctcccaaagtgctgggattacaggcatgagccaccatgcccagccctttccagcttctttaaataactgctgtggaatacactttcctttgaaaatctaaatacatagccactaataaaatgtacttaggtttttatttgtttctgactcataaactatatcagcctttaaaattgcatataataagcagacacattttctttatttttctttcattattttatttaacaattataaggttgctggatttttaaaaatctccagaattgtattgtgcttataatagaaagaatgatgaaaacgtgtcctttatctatagttctgtgaggctatattaacaaaagcatgctttacttttcagtttttagagataatattatatttcattacatttttacatcactcactttcctgatatgttttatatgatttcctttataaatttttatgacgttgtttctactaatagaattttcttttacacattaaaattcttcctttttctgaagc

SEQ ID NO: 381093 - DNA, 507 bp, Homo sapiens
tggtgtgatcttggttcactgaaacctcaacttctgtggctcaagccatcctcccacttcagcctcctgagtagctgggactacagatacatgctaccatgcccagctaattttttaaaattttttgaagagacagagtctcgccatgttgcctgggctggcctcaaactctccggctcaagcaatccttccacctcggcttccccaaatgttgagattacaggtgtgagccaccgaacatggccagcaggcagcttataatcagccaattctaggccatgttgtaaggaagtggacctgtctttgacagcagggtcctggcacccaagtggacacaggtggtggtcctgtaacagtggcttgattacgctgttttgtgtgtctaatctgaacatagggaagtataagatgtgtaagcagctttatcaaagagttataacaagttttactttccagatatgaaatgctgaatttgtataaataaattaaaccttaatagcacagtca

SEQ ID NO: 381094 - DNA, 502 bp, Homo sapiens
cggctttcaccctttccccgcaccccacacactcctcctttcccattacagagcaacacactctccctagaatatatgcactccctttagctgttttctcagctctacatggcaaactcctactcatctgccaagccccacattaaacctcctcttccaggaagcgttcccagactacccctgtcacagtcagtcatttgcttttctatcctcctgcagaccagtgtacctacctctctcatagctcttaagatattaatgataataagggctaaatgtttactgatcacttatcagaatgctagacagccttctacactttacaaaggttaccttatttaactctcatggtaactccatgaagtagctactcttattatcctcattttacagagaatgctactgaggaccagagatattaagtaacttgcccaaggctacagagctattacatagctagacaaatgcctgacacatagtagctgctcaataactattcacc

SEQ ID NO: 381095 - DNA, 660 bp, Homo sapiens
atattcacctatgtctgctccttgccacaggaaccctggcctctcagtatgacaccttttcactgacagagttcttttaatttgcacccaaacaggtatagcatactcaagatactagggcaaggggctcaagaggggttctcaaatcactcttacagtctgcctgaaaccagcacccccaccgtcattacctagattcaagtgtttcattgggtttaatactctcatatgcataatttctaggtagtgtgaccatataaaaatcccaaaaaggatatttttgaggatgaaatggagcaggaaaagtagtaaaaatcatataatttctttgaaatatgtatattggacttacaatttaatatcattatctcattggctgttcaatgaactttattcattgctgaaaatataaaaatattcttgccgaaatatagaactaacatttgttattaaagcaaaataaaaaatgtctttatatgaattattcgtaccttaaaaaataaatgggataattatttttggttcacatacacattcttaatcattttcttagcctgtacctgtttctaacactgtgtcactggcaattttctgaagaatatattttgcaatgttgtgctgttttacattttttaataaaattgcttgcagttttcttca

SEQ ID NO: 381096 - DNA, 276 bp, Homo sapiens
gtacaaagaaacccatctattggaattttaaacattcagattttattctaatccttaattatcaaaacatttttcttccaaacagtggttatcttacatgattctggaaataaggattaaaatttttctttctcagaaaaaacttcctgaaattaaaatttagaaaatttttgactatattttaaaaacatattcctcttatatgataagaaatggtcaaatcctacatgtgatacaacaaagttcagttcaagaaagatgtgtaaaatataataa

SEQ ID NO: 381097 - DNA, 761 bp, Homo sapiens
atgagctgccacgcccggccaattcagcaaatttatgtgggattccacctagaactccaaaccaaggtgctctgaatatgtattggtagtataaacagaatccacagccctatcctggattataagctcgttagggaggtagcaaaatacatgacactgacctaagaacacatgaaaagcaaagaaacatgaatgcaaagtcatgtcatataagctgtttaaatcctgagtaagatgaatttaatttgcatctatcctactgacctataatccgtgactcacttgtctctctcctccagtagacatgactaggcatgacccatatagtactgaactttgtattcccagcaccttaccaaagtaggtgctgggaatacaaagaggagacaccccacaaatgttaaataaaacacttaatgaatggttctaggtaggtggggttgatcaaggaattatcttacaagtggtatgggttttttggttttttctgaggtgcagtctcaccatgttgcccaggtgattctcctgactcagcctcccaagtagctgggattacaggcactaatttttgtattttagtagagacagagtttcaccatgttggccaggtgggtctcgagctcctggcctcaggtggtccacctgcctctgcctcccaaagtgctgggattacaggtgtgagccaccgcgcccaacctagtctttttatagaacagttatctctgtagccaaacttacatcatattatttaattttccttg

SEQ ID NO: 381098 - DNA, 646 bp, Homo sapiens
gaattattatcatttcctctttcacttagaaaatacattgtcgaatgcagcattcagcatttgttgtactttcatgaggcaaaacatatggtctgtttttattttttaagcaacagaacaacacagatgacttcaacagactgctagttggctaaaatataaaatcccgtatgcttctgtatgtcaattcatatctgtgaattttctagctatattttaaatggtaataaatgattaaataattatcttcagaaaccatgttaggagattagaacccaaaggtataaaatatctttttctttttttctgtatggtttcacttttctaatacaaaatcaggccactgtaccttgccatttagagaggtcacatttacaactttgcctatttataagcaaccctgaaggacaacagctaatttgaatggatgtgctgactgcttgtgttgcatgggaggaagccatgcataccccacacctacctcccagaatcccctcagggaggctccgctggtatctctgtcacagattcagtgaccttcccctccagtggagtacagattgatttttctatttcattataatttcatgtttaaaatataggttaagttcacatcaatattcctatgacaatgacagagtcaaga

SEQ ID NO: 381099 - DNA, 3988 bp, Homo sapiens
ccgccacttgattctggaggatttgttctggggctgcggccgcggagtcggggcggccgcgggcgagcttcggggcgggagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381100 - DNA, 4017 bp, Homo sapiens
ggcccttgccgcctccagggccctgcgcgggagctggttggctcctggtgctccccacccccggccgccctcgtacccaccagagcctgggctctgtcaaggagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381101 - DNA, 3217 bp, Homo sapiens
taggctggtacgcctcggagtaacgggatcgtggacggaccccgggagcccagacgcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381102 - DNA, 2198 bp, Homo sapiens
cagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381103 - DNA, 2671 bp, Homo sapiens
ccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccctgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccagcggggatcctcagatcaccgcagcatacagctgcc

SEQ ID NO: 381104 - DNA, 2248 bp, Homo sapiens
ccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccctgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381105 - DNA, 4275 bp, Homo sapiens
ccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccctgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381106 - DNA, 4162 bp, Homo sapiens
  misc_feature (6)..(7): n is a, c, g, or t
  misc_feature (9)..(9): n is a, c, g, or t
ggcacnngnggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381107 - DNA, 3639 bp, Homo sapiens
cctgctcccattaagacgactctaaatgggaaaaaaaggaagagtggctctttgaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgaggaaggaaac

SEQ ID NO: 381108 - DNA, 3541 bp, Homo sapiens
  misc_feature (6)..(7): n is a, c, g, or t
  misc_feature (9)..(9): n is a, c, g, or t
ggcacnngnggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttggtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggccggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactcctggcacacacctgtctgtaacctgttttgtgctctgaaagcaaatagtcctgagca

SEQ ID NO: 381109 - DNA, 589 bp, Homo sapiens
gagcccaaggtcattcttcaggaagccctcctggggttgtctcgagctggaactgacctcttccctgctgtcctccaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccagg

SEQ ID NO: 381110 - DNA, 266 bp, Homo sapiens
gcgtcgacatcccgtatatccatcccttggtatccacaggcgattctttccagcacccattctccccacccccggccaataccaaaatccatagatgttgaagtcccttatataaaatggtgtagtatttggccgggcatggtggctcatgcctgtaatcccagcactttgggaggccaaggagggtggatcacaaggtcaggagatcgagaccatcctggctaacatgatgaaaccccatctctactaaaaatacaaaaaattag

SEQ ID NO: 381111 - DNA, 541 bp, Homo sapiens
ttgaactagttatttaccatctctaagcctctgttttctcacacgcaaaatgggagtagtgtaaaaattaaatatgatatatagataggatgaagaatattaagagttcaatgcatggagttattattgttaatattatttattatctttactcccctcaacaacttcaattgggattctcccctgattctaccttggagaacctttcttgagtgttgtatgctggtcaggactagtttcctggatgtgaccttttcagcattttatacacaaaataatgtcagacactacatattttctgaacaaagacttaggacataattttataaatacatgcatatttatggggataataaaagacaagatttgaaaccaggtctgctccaggagatcagagacttaatctcctatatctaaccttaggatgtgaattctatacactggacaaagatgaattttagagtcgtaaggtaatactgataattaagaatatgatagctctgataaccaattgtattaagaaaggatggtcaattacaca

SEQ ID NO: 381112 - DNA, 1100 bp, Homo sapiens
ggacttgctatatctaaggacttctggggaaccgtgggatacagagagaaacctcaggcctctgagtcttcaatgccagtcccttgccctcccctagactccctgccagaactccagagagagagttccctggaagatccatccagatataagccccagtgggaatgcagagaaaactcaggaaacctctgggcttttgagtctccagtcttggacctcaacccagagctctctggaaccagccctgaatgtgtcccaccagcatctgagacaccatggaagggcatgcaaagtagagaaaatatttgggtccctgcagacccagtttcacctcccagccttccctcagtccctctcctggagtctctagtaatgggcccccagggagtcctgtctgaatccaaagctttgtgggagaccatggggcagaaagagaacctctgggcatctgattccccagaccctgttcatagcacacctccaaccacccttatggaaccacacagaatcaatcctggggaatgcctcgctacatcagaagctacatggaaggatactgagcattccaggaattcctcggcttctaggtctccatctctggccctcagcccacccccagctcttgcaccggagctgctcagagttagatccatgggggtcctgtctgattctgaagctagatgtggggacatacaaaagacaaaaaactcctgggcctctaagcacccagcttgtaacttaccccaagacctgcatggagccagccctctgggagtcttgtctgattctcagtctattgtaggggaaatggagcaaaaagaaaactgtgttcctgtgttcccaggtaggggctccagcccatcctcaaactctgtttcaaagtcccacgtaagtgagcctatcgcagaccaaagcaactataagcctgacggggaggcagtggagcaaagaaagaaccactgggccactgagctcccagcccccagctcactctctactcctctaccagagccacacattgaccttgaacttgtgtggagaaatgtgcaacaaagagaagttccccaaggccccagccctctggcagtggatcccctaca

SEQ ID NO: 381113 - DNA, 917 bp, Homo sapiens
tctgaatacttgcttatttattcttatacaattaatgatcccctcttaagaactaccattgcagtggctgctcccacagagccccctccaggcccttcccccaccaccctgggtatccctagcacctgtaggacagcatcgttgaaacattaggggtgctggggtctgagagggtatcctgctgggacaatgcccgcggaacctcctgcctgtctttagacatggacaaggaagatgcactgatctgttttgaggagcacatccgagctttggagagggaagaggaggaggaacgggagcgggcccggcttcgggagcgacgccaacaacgcaagaatcgggaggccttccaggtatctttgctgtcctttctagatcagagctcagctctgccctagagcacaacctcttcacccattccctgcccccttctggatacgctgcctgttctttctgtgcctagccctgtccaagctctatgagacctctctctgcctgcagtctgtttctgctgtacctcctcaattctggactgtgctcttctagggagactagatgtatgcaccacccagaaactgccagtagagagcaccctacaggcatgacttggcagctaggccatgtttatttcccttggtggggcacccgacaggcagagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcag

SEQ ID NO: 381114 - DNA, 458 bp, Homo sapiens
tctgaatacttgcttatttattcttatacaattaatgatcccctcttaagaactaccattgcagtggctgctcccacagagccccctccaggcccttcccccaccaccctgggtatccctagcacctgtaggacagcatcgttgaaacattaggggtggtggggacagcagaagagagcaggctgtagcgctccagctgttcttctgagacactctgggtttctatgtaggtgccttgagacaagcaagggttggagttgagtatggggggatttggtgctgcttcctgttttcaagtgaagcagcttgaatcttttttatgcataaaggttctacataagatttctattttaataaactgtttctgctgtttaaaaaaaaaagggagaattcaacaccagtgggatagagtcactaagtagaattgatagattttgtgaaatggagggaaaggaagg

SEQ ID NO: 381115 - DNA, 3589 bp, Homo sapiens
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381116 - DNA, 3667 bp, Homo sapiens
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatgaaaaaaaaaaaaaaaaaaaaaaaaaaaaaaaaaaaaaacaaaaaaaaaaaaaaaacaaaaaacaaacaaaaaaaaaaaacaactattcgtgtgcggcgcgcgccgccgcccccaaaaaaaactttctaaaaacacacccctctcttagtgggaggagccggcgccgcccacaataggtgtataagaccatgcgagggcaaaatcgggcttcagacgagaaaacacgcctgtagcaacaaaacgaggggcggtgctactcccacataagaaaaaccaccccgcgggggcaaccacagagttgttgtgatagaaacaccacgcacacggatgctttccgcggagaatctacgaggcgtactcatcacacaaggaacagcaccacacagagcagcaccgaattataaaagatgacccccccgagtcgtgagttaagcgacgaacaagacgctaaagcagaacgaagactaaagagaaaaggacaaagcaaaaaagcaagaaacacagaaaaccgaacaaaggcaagcaa

SEQ ID NO: 381117 - DNA, 3662 bp, Homo sapiens
gttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381118 - DNA, 3624 bp, Homo sapiens
gttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaagggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381119 - DNA, 3719 bp, Homo sapiens
gttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaagggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaaggtgaggggcaggggccctaggccagtcagcacgctggtcaagcttccacggcccttagtgcaggctaagggtgaactgtgcctttgctccaacagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381120 - DNA, 2127 bp, Homo sapiens
gttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtgtgaggggctgggcggggcgtgggaagttctctaattcatctgtgtcttgctccattccttctcactcactgtcccactgactatattcccaattcaggggatggtggtagaagcccagaccctaactttccacctcctaaggtatgcctgagtgggacctggcatccaccctcctgggtg

SEQ ID NO: 381121 - DNA, 2466 bp, Homo sapiens
gttcctgcctatggagggcagatgagcccaggagtccctcttgctttccacagccaggcagaccatgatggtgcctttcatcccataggataatgcaaagagccctggacttagaacaggcagacagatccgggtcagggagatccatggaggatgctcatgagaaatatattctcttgagatctgttgaattttaagtgtctgaaatatccagtctaggatgtttgaaaatcaggagagatgaaggatgagattgcgagggagtacagattgggtagtgaaagaggactaagtgctgttctcaggaacatgcatatgcaagagaataaaaggtcagagagggtgtgacctggagaggggagtgttgaagaagtaagtggtagaggcactgaggaccagatgagtgaggacaaagaaggcggccttggatttggctagtagacacaagcaacctttgggagagtagagtcatggaggtggcatgggggcagcacatgttttagagtcagattactcctggttgcttattggctctgagacctccgtaagttccgtgtctctgagcctgtttgctcacctgtaaatcagggataattcataggtaaggttgtgagaattaaataacatctgtaaagtgtctaataggttctcaataaatgtttattccttttcctttctgctgcatttcaagaggttttgaaacaatggaaaagagcagaggtagttagcttgatgaaggggagagcatggtggaaaggatgttccaggttaggtgaggtgtctgcttgatggaaggagccagtaacaagggtgacttggagctttcaattccctgagaatgaatgctgtgttgataaggactgtagcagggttgaggaagtacccttggaaagaagaaagaggagcacacctctgccatcagcaaaaaggccagaggaggtgagagctatgtggagggagagaaagggaatctggcctgtgcttaactgacgtgagagccagactttgaactccagtggcttcatttaccactcatgtcatcttgggccaactgagatcacttttctaagcctctgcttcactggaatgttgtgaggcctaaatgagaagcatagagcctggcctgtggacatgtttttagtattggtggggagctgcacacctggtggcctccgtttctcccatggactaagtcatctgggtgggtgtggtgcttgaaagcagacactttggggatagagagcccccccagggtagggttcttgcccagccgtatatcagctgtgagaccttgggcaagtgctctagtttctctgaaccttggtttctccttctgtgtaaaattaggatactaggacctattcttaaatgtagaaccaagaggattaaatgagataatgtgtgaaacactcatcatggtacctggtacatagtaagcactcaataaatagacccaaagggtaggggccagcaaatgttgattgagaatgcatggaagcactgctgagcagcaggagggcccagctggggccagagctttaagccaaaggaacaaaagttaattttgagaaactcagcattaatcagcagttgggagacatctcccaaccccttcagctctgtgtgacatccaaaccaagggtaggcatgggggcttaattgtcaagtgatgaggacttggataacttggtttctaatgcagaccacagtcctgtggatctcttccagaggcaagggccttcttgaccatctgtaatgtgaccactctgcctgccagctttggcctcaggcacgtggtgcccctgcttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcagtgagtaagcgtgtagaagggacatggggtgaagctgggttgttttggggaaataaacactttgttttccccttacaatatctcccttggagggaagtttgaggattcctttggccctgggtcctcctcctctctcgaattcccagacgagggcttctggagggcagagaacctctgcactgacatgtatctgctgatc

SEQ ID NO: 381122 - DNA, 1272 bp, Homo sapiens
aaatgaggggaggtcctgaggtgactcctcacccctcctcccacctgccctgctgacttcagagaggggagaaaactgaaaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381123 - DNA, 1165 bp, Homo sapiens
  misc_feature (1023)..(1023): n is a, c, g, or t
  misc_feature (1119)..(1119): n is a, c, g, or t
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctcctcctcctccgtctgtttcctttcacctctgcgccaggtcggtcctccctgccaaccttccccagctccaatatgtagcagtctctntggatggcggagagtgaaggagacggagaaacgcgccccatcccttccgccggctcctttcccccccgaccctattcaggttttaagtcaaaaatntcgatatgtcattatgcactttacagatgaggggaggggccgcagt

SEQ ID NO: 381124 - DNA, 331 bp, Homo sapiens
atccttcctggggctaagtctggtgctgtcctcacccttcttcctctgcctctagcagactgaatgccagcacctccacaccaaaggccgaaagcatggcaggaaaggcaagaagcaccatcacaagcgttcccactcaccctcagtgagtaagcgtgtagaagggacatggggtgaagctgggttgttttggggaaataaacactttgttttccccttacaatatctcccttggagggaagtttgaggattcctttggccctgggtcctcctcctctctcgaattcccagacgagggcttctggagggcagagaacctctgcactgacat

SEQ ID NO: 381125 - DNA, 443 bp, Homo sapiens
tgaggaggtgggctctggactcttacagaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaaggtgaggggcaggggccctaggccagtcagcacgctggtcaagcttccacggcccttagtgcaggctaagggtgaactgtgcctttgctccaacagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttcct

SEQ ID NO: 381126 - DNA, 523 bp, Homo sapiens
agagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcagtctgtggctctgcctccctgtctcactctccctataactggcctctccctgctcagaccttcctggacgagctgcatgagacagggcagctgcactctatgtccacctggatggagctatatccagcagtcagcactgatgtccgctttgccaacatgctgggccagccgggtaaggcagccaggctcccccttctctggcctggcttcctgccctgccagcctctctgcaccccctactaccggctcctgtcctcggcc

SEQ ID NO: 381127 - DNA, 3476 bp, Homo sapiens
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagagatgaactgagactggcagggtcccagggctccctaagcctagatacatctagaccagagctgaccatgggcctgcaaaaaggaa

SEQ ID NO: 381128 - DNA, 3335 bp, Homo sapiens
ggaataagatggaggtcggagcaaggacttagtatgtatcctttggcttttttctagctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381129 - DNA, 3732 bp, Homo sapiens
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggtaaggcagccaggctcccccttctctggcctggcttcctgccctgccagcctctctgcaccccctactaccggctcctgtcctcggcccagcccccaggccttgggaagctgccgcccgccaggcccccctccctccctccggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatggccagtgactcttttccatgtgctactggggcaggctggggactggacacatgcccagcagagggcactagtgtctcatggcaggcctgcttccctttgtgtggctagagcccacctagccggttctcctttccccagagttctgatctcatctcctccaaaacagatgcagtgccccaaagatttcttttctatccccatagcccaggtcagactaaatggccaccctagccccctaagctcagaaagaggagacaaagtcaggcctggtgcatcaagcctttgttgagagggggagagtctgaggtttatgtacagtaagaggaaagggaggtggtacatgtacaaaaaagtgggcccccacattcccttccaggggcagaggagaaacgggaaggtaagcaaatagccaagaccaccatgctccttgtcccctgccaaaaaaaaa

SEQ ID NO: 381130 - DNA, 2113 bp, Homo sapiens
cgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccaggtatctttgctgtcctttctagatcagagctcagctctgccctagagcacaacctcttcacccattccctgcccccttctggatacgctgcctgttctttctgtgcctagccctgtccaagctctatgagacctctctctgcctgcagtctgtttctgctgtacctcctcaattctggactgtgctcttctagggagactagatgtatgcaccacccagaaactgccagtagagagcaccctacaggcatgacttggcagctaggccatgtttatttcccttggtggggcacccgacaggcagagtttattccctcagcttgggggtggcagtggtggtggtagtgctaggggttactgcaggcaggtttctgtttctttgcatcccgggactggcttgttctcacctttttgttctgtccctctctgtgtatttactttctctctttttgcattgttctcagccttccatctgcatctcttcatctctgcctctcttgcctgcatttcctcaatcttgattgtccctgcctcttcctctgccattccctctcttccccctcag

SEQ ID NO: 381131 - DNA, 541 bp, Homo sapiens
ttcatgcactgctgtacccacaggaccggggcttctgcgtggaggtgaacacggcctttgaggacttcgcccacgtcataagctttgacaagagggctgccgcactggacgcaggcaacatcaagctgaccttcaatagtgtgaggggctgggcggggcgtgggaagttctctaattcatctgtgtcttgctccattccttctcactcactgtcccactgactatattcccaattcaggggatggtggtagaagcccagaccctaactttccacctcctaaggtatgcctgagtgggacctggcatccaccctcctgggtgaccctgttccgtgtcccttctttcctcagctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtcaggagcgtagcctggccccaagcacccctcaagcctgagggcagcggtgc

SEQ ID NO: 381132 - DNA, 1155 bp, Homo sapiens
gtttgttcatggagggaagtaaggaaattttaatgatattccttagataatacattttcttacctaaaagtggtacaataatgggttttactctacctcagtccactatgcagcatgcatactctacttaatactaggttgtgttcctacagttagttaaaaaaccaaccagctggtagtatttttttagatccaacctaagaaagacagtgtggtctagtgtagagggcactggctttggagtcagatgggtctaagttcgaatgctggctctgctgcttggaaggtgtgtaactttaggtaagttgcataacttctctaagcctcagtctccgtcaccataaaatggggatatctatgtatcttgcagagctgatatacggttatgcgttacacgtgtacatacagaggcaaagtacatgtacgaagtagatgtggcctgtgaataagtgttagggccaattttacacgatgggtaagctcacaattaggaaacatgaataacttcttttggagtaatatatatatataatggaaagtcagagtataaataatggattcacttcaatcatgtttctttaatgtggatcatcatgacacaattccatctcctagcatgtgtttataaaataaatttctattatccctgtgctttcacattttctcatatatttgagaaattcctagattcttaagcagtgtaatcctatttaatgtgctgttaatggcaatatcatgtttaactagagaaaacagttacaaatgggcctggcatgaactagtcctacaggtgccataaagctacccaaatggtataatgaagtgatgagggcatttggggattctgctacatttttttccttctgaacgtgttggtgggggtagtggactagttttaattagaatcgtttggagaacaggaatccaagcacacgacctaatattctcctagttagccttcggcctgaggcagctgtggacagccttcctagaagtcagtctcaagacaaagaatagagcgggaagtggtttacctagtgggaggtttgcagggggaattgaatgtaagatgggatataagaaaacttacaaaaacaactggaatttttaaaaaatacaccattatgaccatcaaggacattttgcaaaaaaaaa

SEQ ID NO: 381133 - DNA, 517 bp, Homo sapiens
tataaattatatataatatataattaatatataaaattatataaatatatatattttttgagatggatgttcgctatttcacccaggctggagggcagtggttcagtctttgttcactgcagcctccgcctcctgggttcaagcattcctctcacctcagcctctagtagctgggactacagacgcacaccaccatgcctggctaacttttgtatctttaatagagatgaggtttcacccagttgatcagttggccaggctgatctcaaattcttgacctcaaatgatccgcccaccttggcctctgaagtgccgggattacaggcgtgagccaccatgcccagcctaaactatgctatcttatgtaaggaaaccaacacaagaaaaaagagatattattctccctgcagacacaggctaaaggaaaccttacaagtatcacaaaactgcttcctagttgagatgcagagcagagcagtcatgttagggcagcgcaaatcagctgaattcgttttta

SEQ ID NO: 381134 - DNA, 1003 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggtaaaaaaaaaacaaaaaaagggaaaaaaaaaaaaaaactctcctccaaagcggtgggactccgcgcaacaaaggggccgagacccttccagagggggggcgcccgggaaccaacgtttggggtcccctttaaggagaaggggtaaattcccaacgctggggaggataaccgatgggccaaaaggctggtcccctggggtcgacactaggttaacccggttcacaatttcccacacaacttagacacaacagat

SEQ ID NO: 381135 - DNA, 863 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagaatagccaaaaaagtgaaccaacccaaatgggtgaatggatagacaacctgtggtacatgcatatcacagactactcttcagctataaaaagtgttgacctaaaaggaagaggctgaggcacaaaatataatttaaagagtttgcttgagacaaagttaagacagctgcctggaagactcagatgcagatttgaatcatcttctggtgtcattttctttcaggctgaaggacttgctttagatttcttgtaagacagatcaactagcgatgaattatctctgtctttgtctggaaatgtctttattttgctttcatttttgaaagacagttaaactggatatggaattctgggtcataagggctcctcccagcccccagcattttagagttgctgttcaattgtcttctggttccattgtttctcattaaaagtcagccaacttcgtaaatgtggt

SEQ ID NO: 381136 - DNA, 1113 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggtaaaaaaaaaacaaaaaaagggaaaaaaaaaaaaaaactctcctccaaagcggtgggactccgcgcaacaaaggggccgagacccttccagagggggggcgcccgggaaccaacgtttggggtcccctttaaggagaaggggtaaattcccaacgctggggaggataaccgatgggccaaaaggctggtcccctggggtcgacactaggttaacccggttcacaatttcccacacaacttagacacaacagat

SEQ ID NO: 381137 - DNA, 829 bp, Homo sapiens
atgaactgctggattcagtttgcaagtactttgttaaggatttttgcataaatgtttgtcaaggatattgacctaaagttttgttgttgccaggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccagatcaggaaacagcaaccagagggagatgatcacctgaaccactgctccaaaccatgggcagtaaatgctgtaaaggtggtccagatgaagatgcagtagaaagacagaggcggcagaagaatagccaaaaaagtgaaccaacccaaatgggtgaatggatagacaacctgtggtacatgcatatcacagactactcttcagctataaaaagtgttgacctaaaaggaagaggctgaggcacaaaatataatttaaagagtttgcttgagacaaagttaagacagctgcctggaagactcagatgcaggctgaaggacttgctttagatttcttgtaagacagatcaactagcgatgaattatctctgtctttgtctggaaatgtctttattttgctttcatttttgaaagacagttaaactggatatggaattctgggtcataagggctcctcccagcccccagcattttagagttgctgttcaattgtcttctggttccattgtttctcattaaaagtcagccaacttcgtaaatgtggt

SEQ ID NO: 381138 - DNA, 726 bp, Homo sapiens
cctctgctttgcttggccagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggtaaaaaaaaaacaaaaaaagggaaaaaaaaaaaaaaactctcctccaaagcggtgggactccgcgcaacaaaggggccgagacccttccagagggggggcgcccgggaaccaacgtttggggtcccctttaaggagaaggggtaaattcccaacgctggggaggataaccgatgggccaaaaggctggtcccctggggtcgacactaggttaacccggttcacaatttcccacacaacttagacacaacagat

SEQ ID NO: 381139 - DNA, 2265 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagactgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttc

SEQ ID NO: 381140 - DNA, 1756 bp, Homo sapiens
gaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaac

SEQ ID NO: 381141 - DNA, 395 bp, Homo sapiens
tagtattgttaacttctttaaatgatgtaacgcagtcgcaaaaagaagttaacaatactaacacgagaatattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381142 - DNA, 904 bp, Homo sapiens
gtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttatagacagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgat

SEQ ID NO: 381143 - DNA, 12361 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381144 - DNA, 12364 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaccgggggggggagggattcctaggaattttaaaaagaagttggatttaattagaccggctttttatccaataggtaggatagtatgggggaatggtttctttgaagatgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381145 - DNA, 12424 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381146 - DNA, 11601 bp, Homo sapiens
gtggcgcctgcctatttactccattcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381147 - DNA, 10886 bp, Homo sapiens
gtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttatagacagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381148 - DNA, 5431 bp, Homo sapiens
acaatatgtattcagagtatccccttttttaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381149 - DNA, 4196 bp, Homo sapiens
catacaagtttgtgcttcacgtgtcccaggactgtcatctcccctgtcctactgtctccaaggcccacggacaccagctcctgcaggaaggagcaggcagttcccatggtcacgtccagagtcaccttgcccaagaggagttgcacccttccagacttgcggatgagtagcttgccaacctgaccctctgtcaggtcagccagggtacaagcattctctgcccatttggcttctcggtctttctcctgcttgatgagcaccacctgtccgtcctcgccctgcgaacctatgaggttcgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381150 - DNA, 8521 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaagga

SEQ ID NO: 381151 - DNA, 3229 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttaaaaaaaaaaaaaaaaaaaaaaaaaagggggggggggacaaaaagaacacccgcgaggggggccaaattcaaagcttaaccaggtcttccttgcacaagggcccaaagggaagacgcaaaaaaacagagcaagggccggcgtaaacacgccggagggaaaacagtcacggggacctcgggaaagacccacatcggggggggaaaacacggggacaccccaaaagaataggccaggcataacatcaggcaaggggcaaacgagatcacgcagagaatgatacgtaatgcaa

SEQ ID NO: 381152 - DNA, 5133 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaacaccaccaccagaaccagaaacatgagctctagagaatccta

SEQ ID NO: 381153 - DNA, 227 bp, Homo sapiens
gaaccaccgcgtccagcctagttctagaacattgttatcacccctaaaagaaacttggtaccctttagcagtcactgtctatttcttcctccttctaatctctctcgatttatttattttttttaattgaagtttcctttttttccttgcagaatccaagaaaacaggggcccgaaacccaaggcagtacagcagaattaattacagggctcgtccaactggtccct

SEQ ID NO: 381154 - DNA, 207 bp, Homo sapiens
agaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgc

SEQ ID NO: 381155 - DNA, 653 bp, Homo sapiens
cttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttca

SEQ ID NO: 381156 - DNA, 1070 bp, Homo sapiens
agcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagca

SEQ ID NO: 381157 - DNA, 12606 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaagaaaaaggagttatttaatttcttcagatgtatcgagctctgttttcttccccccgagtcctcccaatcttttgaaacattaaggccattttccttaaggatgtttttggctctcctactccccgtgagaaagatctttccatttccagaacttctccacactaaaagtgaaatatttttgtgaaatgcttttttagggcctgccaaactcaggtgagtctgttctctgggataagctggcttctc

SEQ ID NO: 381158 - DNA, 10601 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagtatcataatatgtctttaacaaaaaaagggggcgttaagatcctgaggccagttaacgtcccgtttgtacagggcctagggtaattaagagaaggcggtacattgatggaaggcggacttgagcactctcgggggatgcaaccacataccggaaatagtctgagctcgtttgtcttttctgtacatcgaaaaacattaactagcc

SEQ ID NO: 381159 - DNA, 12415 bp, Homo sapiens
  misc_feature (8717)..(8717): n is a, c, g, or t
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccagcttctctgccttgctctaantcagcagttttcatgcagctgttccctcatcaaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381160 - DNA, 5846 bp, Homo sapiens
agcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaag

SEQ ID NO: 381161 - DNA, 9148 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaa

SEQ ID NO: 381162 - DNA, 7648 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagca

SEQ ID NO: 381163 - DNA, 5854 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttggaggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaac

SEQ ID NO: 381164 - DNA, 378 bp, Homo sapiens
ctcagatccggggacttcccttgggagatcaatcccctgtcctcctgctctttgctctgtgaaaaagatccacctacgacctcaggtcctcagaccaagcagcccaaggaacatctcaccaattttaaatcgggccctgcactccatgggatcagctgacaccacacagaccagtcatctggcccaaccagttctgccatctcacccaggaacagaagacattaagaaaatctaacttcgaccctctatgattccatctccaacctgagcaatcagcactccccacttcccaagcccctacctgccaaattatctttaaaaactctgatccacgaaggctcaaggatttaagtaataataaaactccagtctcccaca

SEQ ID NO: 381165 - DNA, 3154 bp, Homo sapiens
aggggcggggcgtcgggccagctgagctatcccgtcagaccgcgccagtttgaatgaaagctctacaagatggcggcggtcggggccgaggcgcgaggaggtgaggctggagcgcggcccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381166 - DNA, 2553 bp, Homo sapiens
aggggcggggcgtcgggccagctgagctatcccgtcagaccgcgccagtttgaatgaaagctctacaagatggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381167 - DNA, 5176 bp, Homo sapiens
aggggcggggcgtcgggccagctgagctatcccgtcagaccgcgccagtttgaatgaaagctctacaagatggcggcggtcggggccgaggcgcgaggaggtgaggctggagcgcggcccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381168 - DNA, 5267 bp, Homo sapiens
tgaactatttaattttgtcagtgaaatctttttctgcattactggagactgtcgagagattgtctttctttttttaaccacgtgtttgcagtttttcatgttcactttttttttttttttaattttcaaagagcatttcctttgcgggttgtgttttgaatcctcaactagataaaaatgtttaggaaaagcacacaaacacaccttgagtagataagaggaacctcctttatacgtgattcccttaatgagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381169 - DNA, 5155 bp, Homo sapiens
aggggcggggcgtcgggccagctgagctatcccgtcagaccgcgccagtttgaatgaaagctctacaagatggcggcggtcggggccgaggcgcgaggaggtgaggctggagcgcggcccctcgccttccctgttcccagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381170 - DNA, 3503 bp, Homo sapiens
aggggcggggcgtcgggccagctgagctatcccgtcagaccgcgccagtttgaatgaaagctctacaagatggcggcggtcggggccgaggcgcgaggaggtgaggctggagcgcggcccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagcgtaagaagacatacgtaaattttagacacgactaacaattcaacctagtactagtttccatagctaaagaataattccctttaaactacatatccttttaacatttccaaaatatgtattttataaggagggcagcttctgttaagttatggtattattgctgtattaggaaaattaaacattgaggtgcctaccaaatattaatagggtgtattttacaagagtctttacatatgttacttcatttaaactttctagtaactttgtacggtaggtattactttcatattacaatgagcagagcaattaagaggtaaaatgtccaagaattacacagaactgtatcttaatggaa

SEQ ID NO: 381171 - DNA, 419 bp, Homo sapiens
ctattttatacttgtctgaagtttttataagggaaaaaaatctttttaaatgtgcatgcctcaaagacctctaagcaataagcaacttaatttccagtggaacttaaactaaatctctaggaaagtaaacattttatatggcatgtagaagggcttgtttacaccgtttgtacttaaatgggttctaatgttcctttttagtgtgacccaaatcttcaggtgttcaatgttttcattgataacctcgatactcgtcttccccgaatagcattgttttccacaagaaccataaatgctggagaagagctgacttttgattatcaaatgaaaggtatgcttttcaagtacagtttcattggtgtcagtttcaatatgaagaatcaaatcagactaggaacagaccttagatatttgaacca

SEQ ID NO: 381172 - DNA, 2947 bp, Homo sapiens
aggggcggggcgtcgggccagctgagctatcccgtcagaccgcgccagtttgaatgaaagctctacaagatggcggcggtcggggccgaggcgcgaggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381173 - DNA, 2393 bp, Homo sapiens
gtcctgattgtcccaataggaccacactgacaccttgagtggcattcatagatgggagtaccaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381174 - DNA, 5115 bp, Homo sapiens
aggggcggggcgtcgggccagctgagctatcccgtcagaccgcgccagtttgaatgaaagctctacaagatggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381175 - DNA, 5265 bp, Homo sapiens
gctggccaagtaagccactaacctaggtcataaagagttagctttgggaccatttatttccatgatcaaaataaatacatctgggtttaacctgaatcaccatttagtaacatagtcatcagtttcagtacctttgtctttttccaggtaaaactctttagcctcttatcaaacatgttatgccacatctaaattccatattttatgtaatataaggaaaaatagttttatttgtatgatttatacttcatgtgttaggaacctgtgactacatgttctgaactgttagtaagaaaaatggtattggataccttactctttaagatttttaattatttttggtaaaactgggaaatagccgtctgatttgcattttattttcttttgtattttaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctaccaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatattagtagataggtagatgaatgcttctttggttcagtagctacgtaatatacttacagttttttctgtttaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctcc

SEQ ID NO: 381176 - DNA, 1246 bp, Homo sapiens
gattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctcctatcattacagacctccagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctctccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccga

SEQ ID NO: 381177 - DNA, 1618 bp, Homo sapiens
gattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctcctatcattacagacctccagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctctccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccgaatcaacacaacacagaacacacagcagcgcacaagcacacgatgtggggggcacaccatgacgcccctggagaaagcgccttcctaagcccaactcggttttgacaccggggcccccagaataggtggagcgtgacgccggtggtccaacaagcggactgccccaaggagagatccgcggggacaaacaacacggggcgggcgaattccccgcccaacaataaaaaacacgccgccggggaggaaacaccgcagaggcttttctagaaacaacaacccgccatagtggaggactacgacgacgccaccacagcggcggagcatccaccacagcagggggaagcccaaggcgacgcctcgaaatataaatact

SEQ ID NO: 381178 - DNA, 689 bp, Homo sapiens
gattacaggcacgcgctaatttttgtatttttagtacagacgggatttcaccatattggccaggctggtctcgaactcctgacctcgtgatccaccctccttggcctcccaaagtgctgggattacaggtgtgagccaccacgcccagcctctttttttttttttttttctcaccagtatgatgatgaccattttaagaaagcttgtgtggctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctctccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccga

SEQ ID NO: 381179 - DNA, 297 bp, Homo sapiens
ttcatggttaaactcataatgctgctaacaccgaaaaaaaatggcggggggaggctgaggcatgagaattacttgaacccgggaggcggatgttgcagtgagccgagatagtgccactgcactccagcttgggtgaccgtgagactctgaaagacagcggtccataccttccttacctcagaaatccctgatcttgctcagctgacccttacctgatatggccccagatggccttgcataccccacagcatggggaactcactacttggctgaactccctctccatgtcacgtctcc

SEQ ID NO: 381180 - DNA, 205 bp, Homo sapiens
atatatatatatgcatgatatatgcacacacacatatccaaaatattggatatattatataaatataatataatatatttgtatgatatatataatatatatgtatggatttttatacatatgaatacatctatattttatatgtggatatgcaatattatggatgtatttctctttccccagatgtaataaacaactattaaat

SEQ ID NO: 381181 - DNA, 566 bp, Homo sapiens
  misc_feature (38)..(38): n is a, c, g, or t
  misc_feature (75)..(75): n is a, c, g, or t
  misc_feature (80)..(80): n is a, c, g, or t
  misc_feature (101)..(101): n is a, c, g, or t
  misc_feature (106)..(106): n is a, c, g, or t
  misc_feature (121)..(121): n is a, c, g, or t
ccaaaagccaaacaacctgcccccaacccggaaaaacnaaaaacccaaaaaaaaggggcaaaaatcccccatggngaaanccctttaaaagccttcccttngggtnacccccaatgggccncctttccaagtggttaaaaaaaatgtggtttgtcatatgttaatttgccatgatggggtaaggagatgggagggcaaaggttattcacatgcttgctggcttgctctcatttcctgtggttctcactttccctgaagcagttataacctatcagatttgcaaagtcaactcagtacaaatcaatcgtgctctgtattgaaattctggagggtttagagtcctgcaaaccacgatgcaagtcagtgatccaagtgacagccctggcaatttacttgcactcattccttacttaattctttagaggagtaactgctctatgctcattgaagaatgcatgaattagaattgggagagtataggccacacaaaaggcatctgggtaactgcttcttaaaactgggtaattttctccttcaacaatcaaggctactgaggaaaaaaaaaa

SEQ ID NO: 381182 - DNA, 493 bp, Homo sapiens
aatgtcacattctaactggctacagctaatcagcttgcctactctgaatatcaaataactaaataatgggcaaatttccatttgtgaagctttttaatgcttttcttttgttacccatttggctcttttcagttgtttatataatgtggtttgtcatatgttaatttgccatgatggggtaaggagatgggagggcaaaggttattcacatgcttgctggcttgctctcatttcctgtggttctcactttccctgaagcagttataacctatcagatttgcaaagtcaactcagtacaaatcaatcgtgctctgtattgaaattctggagggtttagagtcctgcaaaccacgatgcaagtcagtgatccaagtgacagccctggcaatttacttgcactcattccttacttaattctttagaggagtaactgctttcttaaaactgggtaattttctccttcaacaatcaaggctactgaggaaaaaaaaaa

SEQ ID NO: 381183 - DNA, 438 bp, Homo sapiens
ttgatctcatcaagagtctcttggccctgcacctcagtaggagcctgggtgggagtcaagggtcttgggtggaagggctcgtagaagctgtctggcccgagacacagattcctaaagcctggtctgaggggggtggggctcagggcgcaggtgctggggtttcacccacctggatccccactggttgagtcaaagcctcctctaggcctcagtggccacgtctgtgacatgggcataatggataatggtgattctttctagagtggataacaaggtcagagagatcaagcacgtacaggtgccacaaagctcctggcacttactgtgggctcagctaaagacccttcccttcctctgggcatatgtgtccttggaaccagcagggacagtggctgttttcctcagctctgttctttcggctgccaggctggctccctg

SEQ ID NO: 381184 - DNA, 331 bp, Homo sapiens
ctaatgttaaatgggtgtcttagtccattcaaactgctataaaaatataccttagattggataattcatgaacaaaatttatttatcttggctgggaagttcaagatcaaggccccagcagattcagtgtctggagagggcccaccctgctccacagatggtgccttgttgctgtgctctcacatggaagaaggggcaaggcaattcctttcaacctcttttataaggccactaatcccatttatgaaggcaaagatctcaaaacttaatcattttccaatgtggctgcccccctcttaatacttcaccaataaattctaataaactgtcc

SEQ ID NO: 381185 - DNA, 294 bp, Homo sapiens
tttaaaaggggggttctcaggacacagcctagcagagcacagaatgtcttcacatctccatttttcacaaaaataaagcacacgggccttaattgaagatgagcttcatgaaagcatatctgaggttggtggcagattgtggaaaactgacaaagcatggctttctttattataaacaaataatcaacaaatacaaatagtggattatgaattagaaatggcttgtgttagattgtccagaatatcaaacactacatggatgctgtgctcctgaaacatcactcttaagataag

SEQ ID NO: 381186 - DNA, 653 bp, Homo sapiens
acgcttgaggtgtcgttatcgctggggaaaggaaaatggttcttactggaaaattaggggacgttacgaaagagtcggtgcaggcagcatttagttatgttcgttccagaaatggaacgatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaatttcgaaatggaacgaacaaatagaagccggcgtacagagtgttttagatcaccccctccccaataaagctaatactcacctgagttgtaaaaaactccgggggga

SEQ ID NO: 381187 - DNA, 554 bp, Homo sapiens
atgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaacta

SEQ ID NO: 381188 - DNA, 594 bp, Homo sapiens
cctgactccaccaaatggagcgcccaagtcctgatcggggttaaaacaaatccactccaggggtagcttttgacaggactttctgtttcagatttcaggtactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttgattttcctggtgagttggggctgcgtgtttccatgttttctgaaggttcacataaacatgcagcctgcca

SEQ ID NO: 381189 - DNA, 537 bp, Homo sapiens
  misc_feature (418)..(418): n is a, c, g, or t
ctctggatgcaaagtgtctcatttaatgtgatcatgtgtttgttgcatggataaatgaaataagaagggattcctggctgcttcttccaggcctgtatccctttgtctttaagccctggaggagtcgaccctacattggcaaaaaacatttagcatgtcccttcctctctctgagtactgctacctatcctatatcccaaggctattgaatgcatattttaaactttacagaaaataccatgttatttagtattttaccatttttagggtaggacataggaatgtgttcctatctctcctatattttttctaaccaatgttttctctaatttttaaaccctttcatggagacgttttgtattttaggtgctgtcattcagagtccacaggatggatgaatggatatgaaaatgaacanacgtgtgacacaacactgcatgatttaccggcaatgactttctgatcaagcctgaagtgggttgtagcctctgtatttactttttattgacactttgcatcaagaggggaccgagctcg

SEQ ID NO: 381190 - DNA, 1586 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttctcagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccgcgtagtgcccgaagcctgcaagcacgcctcctgggttccagcagcggcggcagagcggggttggttggacccgccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccgggagagagatcggattttgctttcgctgccgcg

SEQ ID NO: 381191 - DNA, 1981 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381192 - DNA, 2976 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagaggtgagagtggaaatcaagagatttttttccacggggaagttctttttacaaagcgttgatttcttggcaccccgcggggcgggcaactgacacgacctccggtgcaccttctgcgctgtggagcctctggggctcagctgggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaattaaaaaaaaaaaaaaaaaaaacaaaacaaaaaaaaaaaaaaaaaaaaaaaaaaaaaaaaaaaaaaaaacaacaaaaaaaaacaaaaaaaaagaaacaaaaaaagaaaaaagaaaaaaaaaaagagggggggcgccggcggcgaacaaaaacacccagagaggaggagagcgaaaacaaagaaagacacgacgaaatatacaaccaaagggaggagaccaaaagaggaggggagcaaacagaacagacggggggaggggagaaaaaacacaaaaacgagccaagagaaaaaaacacaaaaagagaggacaaaagagaacaagagcaaaacaagaggagaggaaaacaaaaggggaacacacatcaccaacaggaaaacaacaccacagaagaaacaacaacaaaaaaacaagagaaaaaaagggaaacaaaacaaacacaacaaaacagacgagaagagaaacactagagacacaagagaaaaaaaagaaaacaaaaaaacacaagcggaaaacgtaaacaaaagcggaggaagagaaacagagaaagaggaagacacacaaaagaaaaaagaaggacagaaccagagaggaaaaagagcaaacgaagggagaagaacacagagacgagaagaagaggaaaacaaaacagagccaacagagaggaaagaaaagaaagacaagcgcgagaggagaggaagcaacgaaagagaaagaggagcagccaacaagaggagacagagcaaggagaagaaggaaaccaaaaaaagggcaggggagtgaaaaggagacaaagaacagacagaaaagagaagaagaggccagacaagaacgacgcacaaagaccagagaacaagcgagaagacggacagagaacacagaagcgaaagaagagcaggagcagaagagacagacgacaagaagcaaagaacgaaacgagaagcgagaaagcaaggaaaagaccgtcagagagagagcagaagagcaaaggaagagaaag

SEQ ID NO: 381193 - DNA, 1666 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtggtgagggtcgctcgtgggtcccctggcagggagcagggtctggcactcacaagggcgcacgactaggacttgtcgaatgaatcctttgtcgcctttagcttttagtcctttgaagagagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381194 - DNA, 1547 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381195 - DNA, 1356 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccaccgctatttccaccccacccccctcgcacgctttcagctttcgtaaatattcagttaaaaatgaaacctctggccgaggcaggggctgaaggccaagtggtttcggaagtgatcctgggtgagaggaggagaaggag

SEQ ID NO: 381196 - DNA, 1375 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcggtggtcgggtcgtggggcggtagggcgggagcgggggaagggaaagcaaaagctggaaaagaagcaggggagttgtgaaccagacatccagacctcctgaagggctcgtgcagacgtacaggcgggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381197 - DNA, 1163 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatcttctggaagtgagaattgtttttgtttgtttatctattgtagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381198 - DNA, 1477 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcaggtactcagactccacctttacttttacctatgttggcggccccagaagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactagggtttgactgcaatgcagtgtgaatatcgcacatgggaccatttgtcatactgtcagatggcaatacatagatggatagaattttgctgtttgatcaaagctgtgccatcggaaacttgttttcccaagtatgggtacattctcctcttttcctgagtggagaaacctagatctgagcaaaaagcatgaatcaatacaccttgggaggcagggtgtgaaatatttgatgccatttcctttgcttgtaaattgttcatttcatttgaatataaatataaaaggacttctaccaagaacatgaaacta

SEQ ID NO: 381199 - DNA, 1500 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcaggtactcagactccacctttacttttacctatgttggcggccccagaagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactatta

SEQ ID NO: 381200 - DNA, 1152 bp, Homo sapiens
  misc_feature (1005)..(1005): n is a, c, g, or t
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagctgtcattcagagtccacaggatggatgaatggatatgaaaatgaacanacgtgtgacacaacactgcatgatttaccggcaatgactttctgatcaagcctgaacatcccaagacaaccatgctgtgaagaagttggtctaccccactggagaaggaaaggctgttcagggaagtgaagatgccccagctgacag

SEQ ID NO: 381201 - DNA, 730 bp, Homo sapiens
cgcaggggctgctgcttcgccacctgctgcttcgccacgaaagagttcccgtgccgtgggagcaagtctgggacctctggtcggaacggagagtcgcagctgtgtgttagggctaggatggctcctggatgcgcgtgagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381202 - DNA, 753 bp, Homo sapiens
cgcaggggctgctgcttcgccacctgctgcttcgccacgaaagagttcccgtgccgtgggagcaagtctgggacctctggtcggaacggagagtcgcagctgtgtgttagggctaggatggctcctggatgcgcgtgaggcaagtgaccttgcgtgtaaaggggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381203 - DNA, 841 bp, Homo sapiens
atgaatcttaaatatctcttgttttattttgaaaaattgttttcataagatacaattgagcaattgagatttgttctcccagtatctgaagatttttttggtcttgttttgttttttgggtttttggccctaaaattaggtgaattcagctttgggtctatttcatccattctggaaggttccttgggtcactgatctgaggcattcttgatgtggttaggacttcccagcattattttttttagatcctgtttatttaaaatgaaaaggattagcatgagggatggtaacattcctttttgatatctgtagcagcaagttttcttatgattcattattcttcttcttacagctttaaatcatctaggaacttcatataaaatttaattccagtttcaactagttgtggagcatttgatccaaaataaaatgaaagtcctctctgaagctgtagaggaggctcaagaatcagaacaacctgaagttctttaagctgtcagttgaaggactaggtaaaaaacaaatatcatttagtgtgatcattaatgcacatgagtcattattccatgtggttgctgtcgactggtcaggggcacttcaagccctaatctgtactttgtcctgtctctctacaccccgttctactttttcagcttgttgcctgtaatatgtgaatggaaataaaataatcaagcttgttagaattgtgttcataatgacacaaaagacctgagagaatgtaagaacatatagaacatccaaaataagacatatttttggttggtttaaaacctttttgtttgtttcattttcttctgtgcttaatgtatagttactatta

SEQ ID NO: 381204 - DNA, 589 bp, Homo sapiens
cgcaggggctgctgcttcgccacctgctgcttcgccacgaaagagttcccgtgccgtgggagcaagtctgggacctctggtcggaacggagagtcgcagctgtgtgttagggctaggatggctcctggatgcgcgtgaggcaagtgaccttgcgtgtaaaggggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381205 - DNA, 1305 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttctcagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccgcgtagtgcccgaagcctgcaagcacgcctcctgggttccagcagcggcggcagagcggggttggttggacccgccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccgggagagagatcggattttgctttcgctgccgcg

SEQ ID NO: 381206 - DNA, 980 bp, Homo sapiens
caggaaacacggtaaaaatggtgtaaccccattcatggtttttttaaagaaggactaaaaaatgtagagttgttaacaaatggggaaaattacctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcaggtgagttcttgcttttccagaacctcggacccagcgcccccttctcagttctctgaccgcgacgtgtgtggctgggggtggggtggagggtttgcacgtccgcattccggggttcatttggcaacagctgctgcaacgaacgcgggagccaaaagcgggagggggcgccagcctcgccccttcccctccccccacccccaagtctggggcagctaccagctttgagggcagaacccgcgtggcccgagcgggggtctaggcgaaggggcagtgcgtggtatttccagccccgcgtagtgcccgaagcctgcaagcacgcctcctgggttccagcagcggcggcagagcggggttggttggacccgccaggtttgcgtaatgggctgagcggcggcggccgggaatggagcctgctgcgctgcgctcgtaagctgcgcccggcgccgaggacccccggggggcagcgctcggcccatctccggccccttcggctccatctagtcccctccgactggcaaagagaagggattcctcggattcccaaggcacccagcgcccctgcctggggggtcgcctttcgtccattttgctcccccgggagagagatcggattttgctttcgctgccgcg

SEQ ID NO: 381207 - DNA, 1383 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381208 - DNA, 1601 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagagggttacatgcaagcgtgacagtatttacgcaggcagctgtgaagccgtgcgcacgtgcgcggctgggcgctggaacatagtcgtgctggcttcctttatccgaaggcactttactttcaagtggcggcatgctggttcagacggcaagcacccgacattcaggaacggatactcgaccgtcgatgcatcccagagagggtccaggagcatgcgggacgtggcatgtgaggcgaggggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381209 - DNA, 1493 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagggcccgcctggcaggacgactgagcaagttcttggaaaaccagagatattagagcggtgaatcgcgctggtcacgttggacacctgcgcgttaggagattctggagccagagggagagaccccagaaacgccccggtcggcgacccagcccgagacgcctggggtcccaagggaagctgaacgcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggcaaatgacttgcttccattgtttgtttgttcaattgtctgtttgttaaataaataaaacccttttcatgtatctttaaaatta

SEQ ID NO: 381210 - DNA, 1213 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagcccggtgggctcccgggatggttcttccggttctttgtgccgccttcacccagtgaaggagcctgtatccaccctgcccagtcgctgttgggctgctgcggagcttccgctgccatcttcggatcctgtgttccgcccggggctccaccagggcagggatggtgcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381211 - DNA, 1200 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagcagaatggggaaatggagagagaacctgaaagagccccaaactcgaggacctattgctccccaagaataacatcttccagaactagacagaaaactaggcgtctgggaaccctgaaatccttggaggagtagatcatcatgaccctctgtgttccttttggcaaatgacttgcttccattgtttgtttgttcaattgtctgtttgttaaataaataaaacccttttcatgtatctttaaaatta

SEQ ID NO: 381212 - DNA, 1459 bp, Homo sapiens
aagatttgtttttttattatttttttaatttttaaagattttcttttccccccttttccccctcccggccactccggtttgtgtttgccacaagactcataattcctttagaaagtggagtcgaattcataaaagtgatggggggagagcgcggagagggaaggctgggagccccagggagtcttcactacctacactgccgctcagctcccggcgcgagtggaggtcggggtggggagacgcgactcctgcccgggatggctgacactctgcgagccccggcggcccgcggccgggccgggtgactaggcggagggcgcggagggtccgcggcgggcgggtggcgctgcagcagcctgggcacggctgccgccgcccgcgggcgagagtgtgcacgggtgtggaaggccggagtgcgggccgtgaggggtgtgcgcgcttgagccggagcggggctcgcccctcgtcggctcccgccgcccagccggtgatcgctctccggccgtccccggcaccctcggccccccacggcggttggtccgggcgggggaaggagaaagtgagactcggtttcatcaccaatccatcgccagaaggggaggaaattggaatccagcagcggcgagcagcagctgggaggtcacatctggaaatggaaagccgacctcccccttctcctccacctccgtcctcctcctcctcctcctcctcctcctcctctcacccaggatcacttccgaaaccacttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcaggtactcagactccacctttacttttacctatgttggcggccccagaaggtatttatgggtgtagagttgcttcatttcctgttcacactcttgtgtttcctttgttcttagcgtgttccgtgttcgggtattttggttgcttgtttgattactgtggcttttctttacctacaacccaagcctgacgtccctcggttttaaatagcagggggaggggaatcaatgtttgattcaggtgtttcgaagaccacgccacaggcgatgagcagaactcttcatgttgaaacggttctgctacagtactagattgctctcaggcgatttggggttgatacaggcaagccggtgcaaaactggaatactggatatgaagtgaaatgtataaaagacataaaatgtcacaaaatagtttgatcacaagtgttgattttcctggtgagttggggctgcgtgtttccatgttttctgaaggttcacataaacatgcagcctgcca

SEQ ID NO: 381213 - DNA, 476 bp, Homo sapiens
aaaataaacagcaaacttaaagcagaaatccactaatccatgggcctgtaatcatcctcaatatttactaatagcattacattagctttaaggctgtacacagccagagttctgtgagcaaggatatacctgctcataaagagactaactggtttccctttcatgtctttaattcttttcactttccatgcgaattgtcctaagcatttatgctttttataggcttctgatgatctagcctctgatctattcactttcccacttttgctaactaatcccttcctgcctttatcagctgatttttaaatgtcaggctgggtaggttgatttcagaggctatatttaaaaggagatctgagtatttgactcttgattgagacagcatacttagatatttgatgaaggtccaggaggccatttcttattttttcaatcacattttgggagcagaggtatagcggttcacatggcactct

SEQ ID NO: 381214 - DNA, 377 bp, Homo sapiens
tcagacggagtctgactgtgttgcccagatcttggctcactgcaacctctgcctcccaggttcaagcgattctcctgcctcagccaaccaagtagctgggactataggcatgcgccaccacgtccagctaatttttgtatttttagtagagacggggtttcaccatgttggtcaggctggtcttgaactcctgaccttgtgatccgcccgccttggcctcccaaagtgctgggattacaggcatgagccaccgcacccaggcacacctggatttcttatctgcctcctggaccccacccagaaagaacagggtcatcttccacctttgctattccattccaccattactccagcccaattccctgcctctccagggg

SEQ ID NO: 381215 - DNA, 250 bp, Homo sapiens
gcaaagctgcctcttcattgactgcaaacaccaatttctttcacccaggattataagttggtggtcacgggctcactactgccattacagtgataaacagtttaaaccacaacaggatctgacatgtagatcaattctgggtccataaagaatctacacaagaggttgcaggacaggaatttacagccaccagtttttattctctcttgctgcaaaaattacttctgtcaaacacttagaagagtgggaa

SEQ ID NO: 381216 - DNA, 5738 bp, Homo sapiens
agcggagcggcggcggcggcgcggctactgctggggctgctgggctgcggggctgcggggctgcgggtcggggaggccgggccgggccgggccgggccccgctgaccgccatgctgaccttcttcctcgtgtcggggggctccctctggctattcgtagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381217 - DNA, 3149 bp, Homo sapiens
gccttatctgactcttgttttcaacaagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattgattcaatgactcaaaacccgaggtaaaaccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagaaaacaaattccagtactcctggtaagaaaaacagaggccttttaacaagtactccatcttcagagacagctggttttgtgattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagtt

SEQ ID NO: 381218 - DNA, 567 bp, Homo sapiens
ggcctttgctttctccagcactttgttttattaccaacacttgcagtaacaaatgcccctttaaagatgtgttactttccatccataattccccactttggccactcagagattttaaggggcttggaacatcttcagtgctaaaacagatctgaacactaacaaatgccatcttgctccggtgttccagggcacgtaggggcgccacttccctgcaatcatatcaagctcgttgatgttgaggaactgaactactgggcttgccagatgagaggtggtaattggagtgttgccagggagtatcagcctcagttgcgggctgtgggttagcacatgttggcacaatcatcagttgtactttacccaaaagtgttgtttcctctacctccattttgaaatgtgttcttgtcttgtaatttttctcatatggtttgattcagatgtgtctttagacagggccttgaatttctgacttgggtagattcatagtcatgcatttttgtttttctctttctcttgacacgtttttggagaaacgtccataattggtgaattttctgtatgaca

SEQ ID NO: 381219 - DNA, 315 bp, Homo sapiens
ttgttgtggtgattgatactcaagagaagtgagccccgcctcgtctgtttgtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagtt

SEQ ID NO: 381220 - DNA, 498 bp, Homo sapiens
atgactacgatctattatttatagatatcctgttaaggaaattggagaagaaaaaaacctttattgtacaccctttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagttatttgtgatatatctctatgttgaaattctactgaggttcttgtcatttacttttaatcagttaagaaaaaaaattattccatatgcttcttaaatatatgtatttatattaaaagataaagaaccaaaaaagaaaaaacaaaatggcctcgctggcctca

SEQ ID NO: 381221 - DNA, 5680 bp, Homo sapiens
cgcgtgttgatggggtgggtggcggcggggtgggctcaatgtcacgctctggcgctcgtcgcccgtgctcccccttccagccggtttccgcagaatgccagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381222 - DNA, 5697 bp, Homo sapiens
atcattcccagagctgccagagcagtggccctggaaaatatggaagcagctgtcagccatggcccagggcctgagcgtatgattctcaggaaaagtgggcaggacatctgactgtcagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381223 - DNA, 5561 bp, Homo sapiens
acgttggagagcggggccggagagggctggttcgctctgcggccgggcccctcccccgcccgggagcttggcggttccgacaccgcgagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381224 - DNA, 4311 bp, Homo sapiens
ggcctttgctttctccagcactttgttttattaccaacacttgcagtaacaaatgcccctttaaagatgtgttactttccatccataattccccactttggccactcagagattttaaggggcttggaacatcttcagtgctaaaacagatctgaacactaacaaatgccatcttgctccggtgttccagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381225 - DNA, 4111 bp, Homo sapiens
ggcctttgctttctccagcactttgttttattaccaacacttgcagtaacaaatgcccctttaaagatgtgttactttccatccataattccccactttggccactcagagattttaaggggcttggaacatcttcagtgctaaaacagatctgaacactaacaaatgccatcttgctccggtgttccagggcacgtaggggcgccacttccctgcaatcatatcaagctcgttgatgttgaggaactgaactactgggcttgccagatgagaggtggtaattggagtgttgccagggagtatcagcctcagttgcgggctgtgggttagcacatgttggcacaatcatcagttgtactttacccaaaagtgttgtttcctctacctccattttgaaatgtgttcttgtcttgtaatttttctcatatggtttgattcagatgatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381226 - DNA, 3050 bp, Homo sapiens
gtgagacatgtctgagactcctgctcagtgtagcattaagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattgattcaatgactcaaaacccgaggtaaaaccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagataatgcagcttgtgagattttacttgctgagaaaacttgcccttcaacccctgaaaaaacaaagaaaaaagcaaattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagtt

SEQ ID NO: 381227 - DNA, 3217 bp, Homo sapiens
gtgagacatgtctgagactcctgctcagtgtagcattaagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattgattcaatgactcaaaacccgaggtaaaaccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagaaaacaaattccagtactcctggtaagaaaaacagaggccttttaacaagtactccatcttcagagacagctggttttgtgattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagttatttgtgatatatctctatgttgaaattctactgaggttcttgtcatttacttttaatcagttaagaaaaaaaattattccatatgcttcttaaatatatgtatttatattaaaagataaagaaccaaaaaagaaaaaacaaaatggcctcgctggcctca

SEQ ID NO: 381228 - DNA, 1008 bp, Homo sapiens
atccagatggtgcaaactaattgcgttgtctctttgttagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagaaaacaaattccagtactcctggtaagaaaaacagaggccttttaacaagtactccatcttcagagacagctggttttgtgattgatttgtcctcagtgcaaaaagcatcttttgaagaactatttccaaatgtcagcaattatgttaattcaaatgaaattgttcctgtgtcaagtttgcaggaaaattcttcaaatgagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagtt

SEQ ID NO: 381229 - DNA, 353 bp, Homo sapiens
  misc_feature (24)..(24): n is a, c, g, or t
  misc_feature (82)..(82): n is a, c, g, or t
gagaataggataaaggaaatgagnaaagatatatttttttataggtggggagttttttattattttatgattggttgtcgtnctgtttttttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagtt

SEQ ID NO: 381230 - DNA, 525 bp, Homo sapiens
aggacaaccgtctcagatcatttttcttcattttgaaattcaccatttaggccaggcgcagtgactcatgcctataatgccagcactttgggaggccaagtttcctgcaaatgcatcagaaatatgttgtattattagaacatcaccaggaactagacaagtgaaaaataaaggtgttattgtaaagaagaagaaatattctcttcctaaggatacccctcaagatatcataataaaaatggcatgaaaaaacagctgtggctgaattttcaccactttgaagacaggagtgtgaagtcaaagtctataaagcagaatgtctgcctgaaattatatgaaattaaaaattaaaaattctccagttatttgtgatatatctctatgttgaaattctactgaggttcttgtcatttacttttaatcagttaagaaaaaaaattattccatatgcttcttaaatatatgtatttatattaaaagataaagaaccaaaaaagaaaaaacaaaatggcctcgctggcctca

SEQ ID NO: 381231 - DNA, 257 bp, Homo sapiens
ggagtgtcccaacttggaagaacacatgcagtggaagaattctactcttctggataccagtaaagcagtagcgatagagaaggcaccacagttttcaaatgtctcagcaattttcagtgagttgcacacacaggggaacatttctcatctatgttggaaaagcaaagtattttttctcttgaatgatttctaagctaagtctatcagttggattgcctttggctacagataatatctaataatagcataagtatgta

SEQ ID NO: 381232 - DNA, 2529 bp, Homo sapiens
ctctgagcggcacttgcaccgggcagtgccccgctgctgaccaccatgctgatcgcttcttcctctgtgtcggggggcttctgggtagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaagga

SEQ ID NO: 381233 - DNA, 5512 bp, Homo sapiens
gtgagacatgtctgagactcctgctcagtgtagcattaagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381234 - DNA, 5717 bp, Homo sapiens
acgttggagagcggggccggagagggctggttcgctctgcggccgggcccctcccccgcccgggagcttggcggttccgacaccgcggtcagtgcggggcaagccccagacccggccggccaggctgcagggcagggaagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381235 - DNA, 5195 bp, Homo sapiens
ggatcccctgattactctggccgattttgtgcaaaaacaccaataaactgatcagtgcatgctttacaattgtgctggagaagtccggaccccagaaattcagccctgtcggccactagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagaaagtgatctttccgagacaggacgatgtgctcatctccttcctgcctctggctcacatgtttgagagagtaatccagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggttaaagccattcacatccattctgacatgttctcagttcaaaatggcttgctgacaccaacactaaaagctaagagacctgagctgagagagtacttcaaaaaacaaatagaagagctttactcaatctccatgtgaagttcaaggaaagttcttctcagtgtaatgaactgtctagcaatattatagttattcttgaaagtaatgagtcaaaatgacacagctgaaaatgaataagcatctgattttatgactgagccttttcctgtcccaagaggtctttaacaatattttctctatcatcaatgagtatattttatttttattataaaaatgatattgtggtggactgctaaaaatatcacaaatggcaatgtaaaaatcaagacattttctcaagaactgtgtaccactaaaagtaatatattgtcaatgttcacagaactattaaacataaaggaaaaacataagtgatatattctacttaattatttgtgaatcagtaaccagatgcagcaaatatctaggcaatgtggactacctcattcagtaactgattgtcaaaatcacaattaaatcagacttcaaaaattaaagctaggtgtatagaatcatgctaaaagaaaacatgataactcatagtctacgtaacttcagagtctttaaacatgacaatccacattgtcatatgtgaaaattttctctctgatttttactttcattcatgaaaaatgaaaattcagaaattctttttttcctttttgttttgagacagggtctgctctgtcacctaggctggagtgcagtggcttaatcatggctcattgcagtctccatctcctgggctcgagtgatcctcctgtctcacctcccaagtagctgagactacagtacaggcacatgccaccacacctgggctaataggaaattttttttttaggggttttggctcaggctggtctcaaactcctgagctcaagggatcctcccgccttggcctccctaagtgctaggattacaggcatgagccattgttcccagccaaattcagatattattaaaacacatgtcatatttatatagtaacttacaaagacctttcaatacattttctcatttattaagctcattaaagtattcaggaactacctagaaaaaatataatgtaaaactattcaaggatagtgtgtgtatgttcatggacttcttattataatgaattctaaaagacatctgttgactctacaatgaatggatccttgaggaatacttgggagaagaaactcagagttatttctcagggtaggcagcaattaatgtacctacattccttgctggggtcttctagtcttccattcccaatgtgcccatgctatgcctggaaaccctatatggttgtaattctgaacaatttcactttttttccagtaagaatatcaaggcagaaggtgggaaggaggggacattatttccagggaaaatagtttttcaacaatataactttgataaacctctttaaaatgccccaagaaaactttttaagtccatagacaaagaaatactgcctaatggcataattacattcctaaaatctttaagcgtgccgaagtttaaccactaaaacctcctttcttgcattatgtatttagatgcaccctgtattggggtgtcaacaatttcttataattaaaggccagataccatggacagcaattaagttccaagctatagattgtgcctctgaaaaaggcatggaccccaggaacgtgtttttcttctgtagagacaagactctaaaagcatatcaacaatccatatgcaattccatgtgttaatttaaaatgtatgtgctcagtgtttgtagtctagaagctcctttcccttggaggaatgccaagcagtttgcaaaaataaatgctgttagttaaaaaccacataatcacatgggcctactgaataaatatgcatcagtgattatatacttatatttcagtcttgtcaaaagtgaatcactgtttcatttgatgtatttacccagtctttttatccagtttttcttgggcatattctctctgaagacccactgttgcacttctaaatttgacagttaagaaatgagctagttctatacacactgatttttaaaggcgtttctgaataaactaatacttaaaatgtcaaaagtcacatctgtacagcattagatttttatatttaatatatatttgactaattaaaagtgaaagttgttacctgaactggatattcatactattttaagggcaagttgcttacatttcaataacaacaaaaaaagaatctgtttcccattgtcctcctactcaactaaaattcatagttggctttaagcccaaaagaattttgaacaatgtgacagaaacaagtaatgtaaaacttattttgttttatttatactttataatagttagatataacagattatggacaacttaatatttcttctttttggctgggcgcggtggctcatgcctgtagtcccagcactttgggaggccgaggcgggcagatcacgaagtcaggagatcgagaccatcctggctaacacagtgaaaccccgtctctactaaaaaaatacaaaaaattagccgggcgttgtggcgggcgcctgtagtcccagctactcgggaggctgaggcaggagaatggcatgagcctgggaggcggagcttgcagtgagccgagatcccgccactgtactccagcctgggcaacagaacgagactccgtctcaaaaagaaagaaaaaaaaaaaacaaaaacaaggtttcttctttttgccacttaaaatatcttatatttctagatttccaggtctatgtggaaatcatcacacttgggccaataaatgggttagttcagatgtgctgagaaaagtaaatagtgtaccctaaatatcttgcatgtacatttatctatttctctgtttaatgccacttaattttgtaagaaatgagaaatgaaaccctatgtatcagtggaaaaatccttcttgcttcagatttcccaactttattctggaggagaaaaaaatctgtatttctcattaacagagatagaaaaaggtgatgtacttacgatggtcacattcatattgggcattggatctatttaagcctagaagtataacagataatcagttccttaagtgtaaatatgttcttaaatgtttggcctttttatctgttattcaaatgtattagtaattctcatattttgcaaacagatccttttgtgtatattataaaatatataccaaatctgtttttccttttgctgtggaagatgtctttatataatattgagacttcccttgcaaatgagagacgggactctggtcaggtatagtgtgtaggcctagccccatgtattaggaactcataaactcagaaatccaaggattaaacattttatgtctccttcatttatgcaagtcatgctttcattctacatgtagttaaaactacaagtatgagaaaaaatagaactttccattggaattttttccaatcaggtaatgttttagcaacttgaaatcagcacttaatttgattgtatt

SEQ ID NO: 381236 - DNA, 4500 bp, Homo sapiens
  misc_feature (1061)..(1061): n is a, c, g, or t
  misc_feature (3771)..(3771): n is a, c, g, or t
  misc_feature (4500)..(4500): n is a, c, g, or t
cgcgtgttgatggggtgggtggcggcggggtgggctcaatgtcacgctctggcgctcgtcgcccgtgctcccccttccagccggtttccgcagaatgccagagtttgtcctctcacttctggagaagatgcagacacaggagatcctgaggatactgcgactgcctgagctaggtgacttgggacagtttttccgcagcctctcggccaccaccctcgtgagtatgggtgccctggctgccatccttgcctactggttcactcaccggccaaaggccttgcagccgccatgcaacctcctgatgcagtcagaagaagtagaggacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacaggtaagcagaggcacgcagatccccagccatggctacctgcacccttccctggtggcctagcaggtgactgctggagtctttgataccctgttngaaatgggctgagccttgtcttgttcctggctccagacactgggtgacctcctgcacctcccagtgccctgcataagagtggccagatgcagatggatagtgtgcattgggaggtccagtgtgagggcttggcacctcccagagctgagtcagcagagtcatgggcagctggatcatgtgctgagggaaggtcctttctcactggcatcatttctctctggtaaacagctctcactcccctgctttctgcccctgcctggcctttgtgttggagactggggaaagagtgtgaggtttggcgtctgagagccttggtttgagtcctacctccactgcttgctgggggactgtgagccactcatttaacttctctgccaccagtgtccccagtttctcatctgccatgagggtggctaaaggtgccaagtgggagatgggacagtgtgtgaaagggcaatgcagatgctctgcaggctggggctggtgtgccatgagcaaggctgtcaggcaaagcacacaagcagaaatgatatcctctgtgcttggagctgacagaggagcacacacatcaacagtggcaggaataatcaaggaaggcttcctgggggaggcagaaagcacaagaggacacacacagcacaggcacaaccctctgcatttctatagcatgctgtccaccctctctctgcaccactggggcctcagcacagcctgtgaggtgagcaggattgtcaccaagcctgcttgctccaaagggacaccatcagcaagtagaagcaccagggcctgtgccctgctgtcataattcccaggccagagcctttcccagtgctgcctttccatctcatctgatgacgtggatgtcacttgtcttgccctgaatgggcaggaagtctccagccttctttttccaaactgaggattggcccatcttgatgacagctctcagtgggcagtgaactggggctctgcatgccttctgcagatgcagcctctaaggcatttgacagacctgtgaccagccctacaaccaggattattcatgtcagtggatcatgataaacatgctttattgaatatagatagatttttaccattaactcacatgggttcaaggatttccaccatattctactaaactttgtcagaaaaataacaacacagcccttcctctccaggagctgacatccagagccaacccagaattcaaaaatgcccttcaggtttatgttgctttttaaagagcactttccaatgtctttttgtcttgagttttacaatgtgaatttttggtgacatggttttggggagcaggtcactgctatggccttacctttggacctgccttcaaagtgtgccttcagccttttaacaggtcacttggtcacagacattgcccttggatctggagaaaaacttcatgatgcagaaatgtgctattgcctggctggggagggcagacatcatgtccagtgcttttccagactgtaggaagctgagccatcctgctcaagctctgtgtggtggaagcagaatgtatagggcttgaaacataggctgtgatttactatcccagacctcccactccaaagctatggctgttgcctgggcagagctgggggagtgagcagggctctggcctgatatcaccccatctggctgtgcacttggatttccttggctttaggctaagcccatgctgtgcctcttgtactcatcctcttgtcgggcacatcagccttgtgtgtcctcagcgtcacagcccagatacagcttcccttaaatgtaagctaaatgtcctggctcccagcctcatcaagggccacattgttcttttcatggggaaagatggaaaatatgatctgaacctgacatttggcccatgattctggtggaatcattccaggaagatttcattcttagcatgtggtggaaaaaatctgtggagattcctagaataagtcagtactttgaagtccctattcaggccaagaaggcctgggaggtggtgagagcttgtggtctgtctgtacccagtgatggctgaggggtgggcatgtggtttgctgttcatttcaaaataacagttagctggactggaatctgaacccattcccacctctgaaaaaaagataatatgtgggtgtaacatagcccagtttgggaaattgggtctcttgaatgatagttaggatgttttatccttgtgagttcatatgccttgtcttcccagcaaagaaaatacagtgcttttaaaaaacataactttcagtctatgtgtttttagcactctttttctaattcatctatattcactcattcagctcatttttgtgagtacccactatgcatcagacctagcattaggtgctgagggcatagggatggagaagacataggtctgcacccgtgagctcccagcttgtgtcatcaggcagttacaatatgatgcggtcactgccttgaggtctgcatccctggtgcatgggttacccggccactgagagatcagtacagcaggacagaaaggattcccagaggaagtcagtctaagcagagtcctgaaagatctgtagctgcagaagccagggaaaggcattccctgcaggagaaagagcatatgtggaggcctgatggtagcacagaacacgctgctttgagggagttttgagaggaaaagagagggcccgaggcagggcttgagggcacnagcatgagggagatgatgggacaggagttcccaatagaggtcaggcaggaggggctggagaggctagaggagaacaggatttgtcagtgtcgtctgtggttaagttgtaactggaggatgtcaccatgaaatgacctgctggtgctcttgacaaagactggtcccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagactggtcttcccagcactttgggaggccgaggtgggtagatcacaaggtcaggagatcgagcccatcctggctaacatggtgaaaccctgtctgtactaaaaatacaaacaattagctgagtgtggtggcgcatgcctgtagtcctagctacttgggagcagaggcaggagaatcgcttgaacctgggaggcagaggttgcagtgagccgaaattgtgccacttcactccagtctgggcaacagagcgagactccatcacn

SEQ ID NO: 381237 - DNA, 2737 bp, Homo sapiens
gtgagacatgtctgagactcctgctcagtgtagcattaagtttgtcctctcacttctggagaagatgcagacacaggagatcctgaggatactgcgactgcctgagctaggtgacttgggacagtttttccgcagcctctcggccaccaccctcgacagtggcggggcacggcgatctgtgattgggtctggccctcagctacttacccactactatgatgatgcccggaccatgtaccaggtgttccgccgtgggcttagcatctcagggaatgggccctgtcttggtttcaggaagcctaagcagccttaccagtggctgtcctaccaggaggtggccgacagggctgaatttctggggtccggacttctccagcacaattgtaaagcatgcactgatcagtttattggtgtttttgcacaaaatcggccagagtggatcattgtggagctggcctgctacacatattccatggtggtggtcccgctctatgacaccctgggccctggggctatccgctacatcatcaatacagcggacatcagcaccgtgattgtggacaaacctcagaaggctgtgcttctgctagagcatgtggagaggaaggagactccaggcctcaagctgatcatcctcatggacccattcgaagaagccctgaaagagagagggcagaagtgcggggtggtcattaagtccatgcaggccgtggaggactgtggccaagagaatcaccaggctcctgtgcccccgcagcctgatgacctctccattgtgtgtttcacaagcggcacgacagggaacccaaaaggtgcgatgctcacccatgggaacgtggtggctgatttctcaggctttctgaaagtgacagagagtcagtgggctcccacttgtgcggatgtgcacatttcctatttgcctttagcacacatgtttgagcgaatggtgcagtctgtcgtctattgccacggagggcgtgttggcttcttccagggagatatccgccttctctcagatgacatgaaggctctatgccccaccatcttccctgtggtcccacgactgctgaaccggatgtacgacaagatcttcagccaggcaaacacaccattaaagcgctggctcctggagtttgcagcaaagcgtaagcaagccgaggtccggagtggaatcatcaggaatgatagtatctgggatgaactcttctttaataagattcaggccagtcttggtgggtgtgtgcggatgattgttactggagcagccccagcatcaccaacagttctgggatttctccgggcagctctagggtgccaggtttatgaaggttatggccaaactgagtgcacagctggatgtaccttcaccactcctggcgactggacctcagggcacgtaggggcgccacttccctgcaatcatatcaagctcgttgatgttgaggaactgaactactgggcctgcaaaggagagggagagatatgtgtgagaggaccaaatgtgttcaaaggctacttgaaagatccagacaggacgaaggaggccctggacagcgatggctggcttcacactggagacatcggaaaatggctgccggcaggaactcttaaaattattgatcggaaaaagcatatatttaaacttgctcagggagaatatgttgcacccgagaagattgagaacatctacatccggagccaacctgtggcgcaaatctatgtccatggggacagcttaaaggcctttttggtaggcattgttgtgcctgaccctgaagttatgccctcctgggcccagaagagaggaattgaaggaacatatgcagatctctgcacaaataaggatctgaagaaagccattttggaagatatggtgaggttaggaaaagaaagtggactccattcttttgagcaggacctaccacagtgcttaatacagattaaggtgttcagtaaatattgattcaatgactcaaaacccgaggtaaaaccaggttcgaagagaaaaggcaaagtgcacggcttgtcgaagattgcagagaaagcagagcggagcaggcagggaggtagcggctctgggccgttcagccctcgcttaggagttacaggagagaaaagcctgcaagaaaataggtctagtgaagacacccaggatgagaagattgcatcgttgcgtgaatcagttactgatgacctccaggttgatagtagttcatcaaatagtgaactagtatcaggattaagtttgcaccatggtatggccagttctcttctgagctattcagtcacagactcttatgcagaatacaagagttttgaagagagctttccatcacctgaactgttcagaaaatcagattatttagactgggagtgtcccaacttggaagaacacatgcagtggaagaattctactcttctggataccagtaaagcagtagcgatagagaaggcaccacagttttcaaatgtctcagcaattttcagtacctcttcagaagactatcagaaatgccatagaaaaacagtgatgacagtagcagatcaaaatgtttctccaaaagcaaagtgtgcttcaaattcagaatcagataatgcagcttgtgagattttacttgctgagaaaacttgcccttcaacccctgaaaaaacaaagaaaaaagcaagtattgaagcagaataactacataaatcataatacatttcattaataaagaatatacttttaactaacagt

SEQ ID NO: 381238 - DNA, 377 bp, Homo sapiens
ttttttttttcgagatggagagtcgctgtatcacccaggctggagtgcagtggcgcgatctcagctcactgcaacctctgcctcccaggttcaagcaattctcctgcctcagcctcccgagtagctgggattacaggcatgcaccaccatgcccggctaattttgtatttgtagtagagacggggtttctccatgttgaggctggtctcgaactcctgacctcaggcgatccgcggcctcggcactcaaagtgctaggattacaggcatgagccaccacacccagccgtcattgtctattcatgcccaaacttgattgattgttaatcctggtggcatgactggaaaactgaaactcatagccctttcagtttgttc

SEQ ID NO: 381239 - DNA, 585 bp, Homo sapiens
  misc_feature (39)..(39): n is a, c, g, or t
  misc_feature (42)..(42): n is a, c, g, or t
attcgcggccgcgtcgaccccaaatgccatcccctaagntgncggtctatgggcctgggcacagcactttagaacttggacaaaccagagtgcttccagcttggtagtggaggggacggggtggggaccaagatgcagaggggggttgatgctatgtcaccatccaaaacacattgtaaggccctggcactgtttctgctggagaagagaaagaggttagaagagggaaaagcattaatcttatgtctgtaatcttatgtaaaggacagaacaaaaataaaataggaatatccatgaataaagttctggagactgaggcaggagaatcgcttgaacccaggaggtggaggctgcggtgaggcgagatcgtgtcattgcgctccagcctgggcaacaagagtgaaactccgtctcaaaaataaataaataaataaagatgaaaatgctagggtttggggtagtttcccaattttcccaaggtgcatagccatgatcagttggctgaaggtgtatatgcgtctgcgtgtgtgtgtgtgtgtgtgtgtatgtacctgtacacacacatatatggtatacgtgtatata

SEQ ID NO: 381240 - DNA, 434 bp, Homo sapiens
gccatacttaatattctaccttaatgggaaaaaaaatcatcatatttttaggtgcaggatattctcaggttccttcaaagtttacatattagggaagttaatggctaagttaaacctctctggggcattcagagtatagaaagcaagggatgagagttgaaacagatggtggtagtgggctgcaaataggcaatattaaaatacaaccatctttccactgtacaaatgtacatgtagaaattttttagaaaagcatgaagaagcaaaaagtcatctataatctcattactgaaagaaattgttaacgtttggattaatatctcaccaggcatggtggctcatgcctataatcccagcacactgggaggccaaggtgggcgatcacttgacgtcagaagttcaagaccagcctggccaacgtgatgaaacctcgt

SEQ ID NO: 381241 - DNA, 454 bp, Homo sapiens
gagcaactagtacagtgcctcacacagggcaggtgctcagtaaatatttgctgaattgtacttgtagcttttagaaaactagaatctacaatgattcaattcgatagtatgaatttctaatgttagagatttcaaagaagtcagtgtggagaataatctttaacactgtaataatgaagaataagggaacaataaaggcaactcaattgtttttaggcaacaggtcaaattaaggatctatgatgatagttcattagattcaaatgtaagattaggaactggtggggactaagaataatggactaacttggttgttttagaattctcaatgttttctacaaagtcttaatatgatggataaagcaattaactaaatgaaataactaagataaaagagaagctttagaaactgtgagaagcttctaaaacttacttttaaaaagaagggtaatat

SEQ ID NO: 381242 - DNA, 335 bp, Homo sapiens
tatccaatggggaaataacttttgagtttggagaacattgtatctaaggaacagttgccaaagcagatattacagtgaaaggtgagatcaatagacttaacgtgacctgatcttattagttgataagaaaaagttttggaagtacataaatacaaacacacattttttaagggtgaaacagaaattatatttttcatgttactttaggtaaaactgttttgttgggctgtactactatgatgatcaaatataaccttaattgaaaatttttatagagcttattttttcagaaatattttatcccagtacatttaggaaattacaaaaaaaaatac

SEQ ID NO: 381243 - DNA, 1601 bp, Homo sapiens
gagatgcaacccaaaggagtaaggcagtgccgggagcggcagaagcggagcgggggcgagggcaaggtagccgcggccacgctggctgcggcatggagacacgggaggaacgggacccgcgggcggcacgggaaagggctgcggctcagaccactgcggcgggacgggcggatcagcggggatctaagtctcctgaggcaagggcgccccgaccgcagcgactcctgacacacccaggccgcaggacgaagcgctaccgcctggggctgccagctcccgcctcccgcccgcagagcccgggccccacgtagaggatccggcgccgccgacactcgcacactcaccgcgcgcgcgccacccttgcgcggcagcccgccgccctcggcgcgacctccgccccaccccgcgcgccgcggcgcctgggctacgtcacgggcgcgtgcgctctccgcgcgccgtcagcggcgcgggtggggcattgccagctcggcgtcccggttcccttggagacagagctggccaggcggccgcggctgggcaactacgacagcggagcccctggggaagccaagatgccgtcgaagggaaaggacaaaaagaaaggcaagagcaaaggcaaagacacgaaattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaaggcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaaggttccctctcatttagacttggtgtccttcttttctttatttaaggattgggttggtaaataccaaaaattgggtataataatgatatataaggacaatgagaccattttcatctgtctggatgatgcactttttttatctgaaaaggttaaatactcaatcttataatgcttataagaagcattaaactcaacttataaagaatatatcagaaacataaatatgacccttatcctctactaccttagaatattcatttttctttgcttagagttggtccctgagtcacttaggaatacatttagcggtgagtaacagtcctgacatcagtggcatcaccacacaagggtttattctttcacctaaaggaggcctggaggtaagcaatccacagcaggaatggtagtgccacaaagttaatagacactcagcttccttaactttgctctgcaacacttggcttacatcctcaaactcacctcacagcctggggggcgctgctggagctctaaccattcctttaaatagcaggaagga

SEQ ID NO: 381244 - DNA, 1901 bp, Homo sapiens
gagatgcaacccaaaggagtaaggcagtgccgggagcggcagaagcggagcgggggcgagggcaaggtagccgcggccacgctggctgcggcatggagacacgggaggaacgggacccgcgggcggcacgggaaagggctgcggctcagaccactgcggcgggacgggcggatcagcggggatctaagtctcctgaggcaagggcgccccgaccgcagcgactcctgacacacccaggccgcaggacgaagcgctaccgcctggggctgccagctcccgcctcccgcccgcagagcccgggccccacgtagaggatccggcgccgccgacactcgcacactcaccgcgcgcgcgccacccttgcgcggcagcccgccgccctcggcgcgacctccgccccaccccgcgcgccgcggcgcctgggctacgtcacgggcgcgtgcgctctccgcgcgccgtcagcggcgcgggtggggcattgccagctcggcgtcccggttcccttggagacagagctggccaggcggccgcggctgggcaactacgacagcggagcccctggggaagccaagatgccgtcgaagggaaaggacaaaaagaaaggcaagagcaaaggcaaagacacgaagaagttaataaaaacagatgaatctgtggtggacagagccaaggccaatgcctccctttgggaggccaggttggaagtcacagaactctctaggattaagtatcgtgatacttcacggatactggcaaaaagtaatgaggacttaaagaaaaagcaatgtaaaatggagaaagacataatgtcagtattaagttacctgaagaagcaggatcaggagaaagataatatgattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaagcaccgactagaacaagaggctgaaaagaagataataatgctagcagagagagcccaccatgaggctattgtgcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaaggttccctctcatttagacttggtgtccttcttttctttatttaaggattgggttggtaaataccaaaaattgggtataataatgatatataaggacaatgagaccattttcatctgtctggatgatgcactttttttatctgaaaaggttaaatactcaatcttataatgcttataagaagcattaaactcaacttataaagaatatatcagaaacataaatatgacccttatcctctactaccttagaatattcatttttctttgcttagagttggtccctgagtcacttaggaatacatttagcggtgagtaacagtcctgacatcagtggcatcaccacacaagggtttattctttcacctaaaggaggcctggaggtaagcaatccacagcaggaatggtagtgccacaaagttaatagacactcagcttccttaactttgctctgcaacacttggcttacatcctcaaactcacctcacagcctggggggcgctgctggagctctaaccattcctttaaatagcaggaagga

SEQ ID NO: 381245 - DNA, 1045 bp, Homo sapiens
gagatgcaacccaaaggagtaaggcagtgccgggagcggcagaagcggagcgggggcgagggcaaggtagccgcggccacgctggctgcggcatggagacacgggaggaacgggacccgcgggcggcacgggaaagggctgcggctcagaccactgcggcgggacgggcggatcagcggggatctaagtctcctgaggcaagggcgccccgaccgcagcgactcctgacacacccaggccgcaggacgaagcgctaccgcctggggctgccagctcccgcctcccgcccgcagagcccgggccccacgtagaggatccggcgccgccgacactcgcacactcaccgcgcgcgcgccacccttgcgcggcagcccgccgccctcggcgcgacctccgccccaccccgcgcgccgcggcgcctgggctacgtcacgggcgcgtgcgctctccgcgcgccgtcagcggcgcgggtggggcattgccagctcggcgtcccggttcccttggagacagagctggccaggcggccgcggctgggcaactacgacagcggagcccctggggaagccaagatgccgtcgaagggaaaggacaaaaagaaaggcaagagcaaaggcaaagacacgaaattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaaggtacagattattagggttaatttaaaatgttttgtttactagaacataagtgtatttatatgcattctgaaacatcagccttccatttggtatcttaatagaagattagaagattgttaccaaatt

SEQ ID NO: 381246 - DNA, 164 bp, Homo sapiens
tggaaggtactgccaaaaaaggttttctgcttttacgccagcactttcctggtgttttggctaggagaacagaccttttttggagcttttcagtcaataacagatagtacatccaagatggagccttcttcagctccctgtgaagaatatgcaggaaataatca

SEQ ID NO: 381247 - DNA, 441 bp, Homo sapiens
gagcttgcagtgagccgagatcgcgccactgcactccagcctgggagaccgagcgagactccgtctcaaaaaaaaaaaaaaaattagccggacgtggtggcgggcgcctgtagtcccagctacatgaagaggctgaggcaggagaatggcttgaacccggcaggcagaggttgcagtgagccgagatcgcaccactgcactacagcctgggcgacaagagcgagactccgtctcaaaaaaaaaaaaaagttacatgaattgatttatatagaacttctagtttcctccctccaggcacgcggggtgtctttatcaccagttcagcccagcacccgccacatttagtctcttctatcccaagccctcacactgcagctcagtcttccctcagttctttccgcccctgcactcagtcctcattctaggcagctctcaacgcac

SEQ ID NO: 381248 - DNA, 697 bp, Homo sapiens
aagaaaaaaaaaagaaaaggaaagaagaaagaaaaagtatcccagtcggtcagagaagcctgccagtggcagcggaccagcgaactctgttgggaagaaaggccaactttgagcagttcctcgcgattttttcctcctttatcttctagctggggtcctcctcccagtcaaagccgaagggtcctagcagaagaaagtgatttgttcattcccagcctcctttctcccgaagttctcccctcctaaaaggtcctgtcagtcaaggtttctgattaaaatcactctcaaatggtcgccactgaggtctagctgggaacgaagagatctgtctactcttcacccacgagtttcattcacagatttttcatcttattaactgtctgccaaaggtccccgaaactcctgttgattcagttgcttttcgtgttgttttgtcttccaaaattgaatgaaaatttattgattatccattttaattatagtatttcattaaatgttgtagtctaagataacttatcctttcaaatgttctaaaaataactttaaaatggtgatttaaagttacctctgaaaatgcatagaaattaatttttggtcttattgcagtgctagaatagttcttgtctctgtgcttttggaatgttcctagagagacctgacccgtcaaaaacataaataaataaaacttttttatgta

SEQ ID NO: 381249 - DNA, 468 bp, Homo sapiens
  misc_feature (436)..(436): n is a, c, g, or t
tccagactgccttcagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacctgactaggacagagaagcagtctggagagtgctgaagcngtctggaggtatcaccgttctaatcatgtcaa

SEQ ID NO: 381250 - DNA, 707 bp, Homo sapiens
tggctgctgggggccaataaagctgtgtaacttgatcgtgggtgtggggtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaagaaaaaagacaccaaagaagaagcaaaaaaacagaaaaaaaacaaaaagaagggaggggcgcgcggcggatcaaagaacaggtgcgcggcggggggggccagacaccgtcacacagaccgccggcccatatgtggtgaaagggaagcgccgcgaccaagagaggggcccataaatagagacagagcgccagcagcgtgatcaaaacctccgcgggggagagaacacccgggcggggtcttacgacgacacccaccccctcgggggggccgaagaaagcgaccccgcgaagaggcgcgggcgaaaacaag

SEQ ID NO: 381251 - DNA, 381 bp, Homo sapiens
acgcttctgtggggggactctccggccccatcaagctgccatcaagggctggcagctgcctctgtgggccggcttcatctctctgtggcttccctgtggctttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcagctaacttgctgctgctgttgtcctggaagcctcagaggtggctgcagctgcagagagctgggctgaggctggggctggg

SEQ ID NO: 381252 - DNA, 3049 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgtatctttcccctcatcccctccctttataaaaacacaaagtcctcagagctggg

SEQ ID NO: 381253 - DNA, 3080 bp, Homo sapiens
  misc_feature (1569)..(1569): n is a, c, g, or t
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggtgaggcccaggtgggcaggccgtgggtaggcagggggcaccgcggggcctggcatagcccngcagcctggctctgtctcgaggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381254 - DNA, 3083 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggggtactggggcctgactggactgctgggggacagggtggcgggtggctgggcatctgcggatgctcagtgctagctttcccccaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381255 - DNA, 2648 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381256 - DNA, 2213 bp, Homo sapiens
  misc_feature (13)..(13): n is a, c, g, or t
  misc_feature (25)..(26): n is a, c, g, or t
attaggctaggtngaggctgggtgnnaatcggccgagggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381257 - DNA, 2346 bp, Homo sapiens
tccagactgccttcagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaagggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381258 - DNA, 2514 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagaggaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381259 - DNA, 1404 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggggtactggggcctgactggactgctgggggacagggtggcgggtggctgggcatctgcggatgctcagtgctagctttcccccaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagaggagaaagacaaagaacgacaggaagagcataaagcagatgaagaacacgaaaaggcaaggagaatacctgaggccaaagactgagaaaaagactgacagaaaagaaaacagggcaaacggagaatgacagaaaccacggaaggaaggggagaacctatgaaagaacgaacaagggaaagacagaaacacgaagaacgaaccagctacatgacagaaggagacaaacgggaaacaaagtaactaaagggagaccgcgggagggagagaaaagacag

SEQ ID NO: 381260 - DNA, 272 bp, Homo sapiens
tggctgctgggggccaataaagctgtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381261 - DNA, 843 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacggtcaacccacaagccacggtcaacccacaagccacggtcaacccacaagccacggtcaacccac

SEQ ID NO: 381262 - DNA, 2997 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381263 - DNA, 2706 bp, Homo sapiens
  misc_feature (13)..(13): n is a, c, g, or t
  misc_feature (25)..(26): n is a, c, g, or t
attaggctaggtngaggctgggtgnnaatcggccgagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcactttgggaggccgaggtgaaaggatcacttgagcccaggaattggagaccagcgtgggcaacttagcgagactccatctctacaaaatgtggtgacacatgcctgtagtcccagctactcaggaggctggggaaggaagatcacttaaggccatgagtttgaggctacagagagctatgattgcaccactgcactccagcctgggcaacaaagcaagaccctgtctcttgaaaaaaaaaaaaaaaaaattaaaaaacacgtgtagctgtgggtaaggaagtcgtcccattttatggatgtggaaactgaggctgacttaaacttcccgtgacttggagctctcacctcgagacacctcccagaccccacatcccctcagaacgctgcgcccagccacacccacgatcaagttacacagctttattggcccccagcagccacagttcccccaagggggctttgggacagggagggcccgggcgtccagtgcaaactacagtacgtgagtcaggccctgaggggggtgcccggggtcctccttccctaccctgccaggagggccccgctggtgggagacaggtgtatgggctctgtgggctctgtccctggctgaatggccccagactggttgcagctgggcttgaggggctgacaacaggaagtaccatcatcactgccagagctcaagatcccacacccgacatgacataaataaaaaaataaatagtgttgta

SEQ ID NO: 381264 - DNA, 2354 bp, Homo sapiens
  misc_feature (2285)..(2285): n is a, c, g, or t
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacagggaagccacagagagatgaagccggcccacagaggcagctgccagcccttgatggcagcttgatggggccggagagtcccccagcacaggaagaggaagcccctgtatcaccccacaagaagccagccccccagaagcggaggagggccaagaaggcacggctgctgggccccactgtgatgcttggtggatgcgagttcagccgccagagactgcaggcctttggcctcaaccccaaacggctgcacttccgccagctgggccggcagcggaggaaacaacaggggcccaagaacagctcctgagcaccagggagcaggcaggggcctcaggctcctctcctcaaatcaagccctggacaggtctcgcacccacaagtactatctgctgcagagatcctctcatctgtggccaggcacgcctgtaatcccagcacttggagccagtgaagatcctnacccgaatgtgaccctggcacttagagactcctctcaaagtgtgcacatccttgtccacttcgagggag

SEQ ID NO: 381265 - DNA, 1891 bp, Homo sapiens
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggattacatcctcaacaaacgctatgaggaggaggaagaggaggaggaagatgaagaggaaatggaggaagagaagggggtccacggtcccccagtccagctggctgtggacgactcctcagacgaaggggagctgtttctgaagaaacaggaggactttgaacagaagtacaatttccgtttcgaggagccggactcagcatcggtcaagacctacccacgcagcatcgcgtcctccgtgcgccgtaaggatgagcgcagaaaggagaagagggaagagactcgggagcgaaagaagagggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcagaagtgctttggggacgagtactacggggccgtggaggaggagaagccacaatttgaggaagaagaagggcttgaagacgactggaactgggacacgtgggacgggcctgagcaggagggagactggagccagcaggagctgcactgtgaggaccccaacttcaacatggacgccgactacgaccccagccagccgaggaagaaaaagcgcgaggcccccttgacgggcaagaagaagcgcaagtcgcccttcgccgcggccgtggggcaggagaagcccgtgttcgaacccggggacaagacgttcgaggagtacctggatgagtattaccggctggactacgaggacatcatcgacgacctgccctgtcgcttcaagtaccgcacagtggtgccctgtgactttggcctcagcactgaggagatcctcgctgctgacgataaggagctgaaccggtggtgctccctaaagaagacctgcatgtacaggtcagagcaggaggagctgcgggacaagcgggcgtacagccagaaggcccagaactcatggaaaaagcggcaggtcttcaagtcactctgccgagaagaggcagagacacctgcggaagccacggtcaacccacaagccacggtcaacccacaagccacggtcaacccacaagccacggtcaacccac

SEQ ID NO: 381266 - DNA, 1093 bp, Homo sapiens
  misc_feature (1061)..(1061): n is a, c, g, or t
gcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagttccgagtcggactcaagcgacgagcgcgtggaatttgatccccagcaggagcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacagggagacttccaatcacagactccaggagacatcgtcgcaaagttatgtggaggaacagaaacagctcaaggaaagcttccgggcatttgtggaggacagtgaggacgaggacggcgctggggagggcggctccagtttgctgcagaaacgtgccaaaaccaggcaggagaaggcccaggaggaggccgactacatcgagtggctgaagggacagaaagagattcggaacccagattccctgaaggaactgacgcatctcaaggaatactggaacgaccctgagttggatgaaggggagcggttcctgcgggacttttacaaaacgctctccttgttgaagaagaaggacccccgcatttatcagaaagatgccaccttctataacagaacagcatcgtcatcagacagtgaggaggacccagaagccttggagaagcagaagaaagtgcggcccatgtacctgaaggactacgagaggaaggttatcttggagaaggcaggcaaatatgttgatgaggagaactcagacggggagacttccaatcacagactccaggagacatcgtcgcaaagttatgtggaggaacctgactaggacagagaagcagtctggagagtgctgaagcngtctggaggtatcaccgttctaatcatgtcaa

SEQ ID NO: 381267 - DNA, 693 bp, Homo sapiens
cctgcgagtggctggagggtacctgggatccaggctccctcaacaccccgtgggctcccagtgctcatctgagagacggaggggcattcagacacgtggtccttcacggggctgctgggcactgggcagcagtcagcgggcacctgctgcctgaccgtctgtctgcgggccctgttccctcatctgtatatgggaattacagtagagtgtgtgtcacaggctgtagtacatagtatgtgctcaattaatgttggctcttattacttttgctatttattatttcccttctgttcctccgttctcactgttctggagagctgtcacctagacctcaaaaacacagggacctagacccttttagtccaggtgaatcaggagggctactttttaggtcaggttatgggaaagagctaggggaggccaggcacagtggctcccagcactttgggaggctaaggcaggaggatcacttgaggccgggagttaaagactagcctgggcaacatagcaagacgccatctctacaaaaaaattaaaaattagccagacgtggtggcatgccctatagttccagatacgggggaggctgaggcaggaggattacttgagccgaggagttcaaggctgcagtgagctatgatcacaccactgcactccagcctgggtgttagagtgggaccttatctctatctt

SEQ ID NO: 381268 - DNA, 555 bp, Homo sapiens
ggcaaacactctatatcaagacccccctccccgagagctggttgttaaacatttgtcagcacaccactgctgctgggagacagagagaagaaactgatacacgtgagcactgaaacatcttagttccagggaggtagcatttgtgttgtatttctcagaagcaagtgtcctagtgtaatgtgcacaagtggcatgaagtttaacacctaaaagactgcttctctgcttgttctgtctaatttctgtgatttcaacacttgagaaagatgtttactttgctactaaacttattggagtgatttgtaaagttcactgtcacctgtgggcagtagttcagctaaattccctccaggaaagtggactgtagcttttcctgcctaactggcaaaatgaaaatatgctgaaaagaatacatcttaactaggcaccagaatagctcatttccaagtggtttatacagcaataacagtgttaacttctccaacagagacgaaatcatttataaatgattgttttgctgtttttgctttttattaaaattattactatggaaca

SEQ ID NO: 381269 - DNA, 390 bp, Homo sapiens
tgatacataaagttcacatttttttttttataacttcatggtcaagagcttgggaagaaagcccaagtctcacttgaggacctgatgtaattgcttctctttgagctccgaagaaaagattgaggagctgctcttttgatttggggagtgagcaggttaagtgctcttactttactttgccaccctcgtacagacaaagtccggttacaaaggcgggtaactccaatgtgctattctttttttcttaccagctttactgggataatgcacatactgtacaattcacccacttaaagtgtacaattcagtggttttagtttattcatggagttgtgcaaccatcaccataatctatttttaggacactttcatcatctcaagaagaaacct

SEQ ID NO: 381270 - DNA, 265 bp, Homo sapiens
attctgcatcaacagtgaagagagtcctgccggaatacggaggagaagcggcacataaacctcaatgggtgactgccaccacacacagttctgtccacgcccaggtgacactggacacggacatcaggacatgaaaacgcttgctctattggaggggtgagaaatgggggaatgattttgtcttttctctggatttctctgagtgtttctgtataattattgcacgtgtggctgatggataagtaaacagacatttgcagcttgg

SEQ ID NO: 381271 - DNA, 381 bp, Homo sapiens
actctgtggctcttcacagaaaaaaaaaatgtttgccagatcctgacttaaaagattcatgacatggttttcataaagaaacctactaggggaaaaacagtgctatataagtacaaaagtgttacaactatttcatttctaaatatgttgctattatttctgagctatttgcttgtgggccttataatggtaacaggtgctaatgcgcaagaataggatggtaactcctaccataattgtccacattcatagaaaactgcaggtatagctgcagccagatgtttaaagaatggaaattgaaatgaaaatgtaaaatctttactgaaaaaagggtagaaatgacacaggaattgcaccaatgacctgttaagaagcataggc

SEQ ID NO: 381272 - DNA, 708 bp, Homo sapiens
gcagcctcaattattgcctcctcagacgaaagaatctgaccaaaggccataaggcagaagaagagactgaggcaagttttagaacaggagtggaagttcattacaaagctctagagcagaaacaaaaggaaggaaagtgcacttggaagaggccaagtgggcaactcgagaggcaagtgccccatccggcctctgatgtagggttctaggtgttggcatacttcagggcctcgcgtcccttctcccaattcctcccttggggtgggctgcctgcacacacactggcctgctagcacttgggagggagcatgcgtagtgtgtttactggagcatgcgcatgctcacctgaggcgatcttcccttcccggtgtaaagtacctggaaggtcacacaccagttaaactccaccattctgtgccttagtgcacatgcttgagcccacttgcccaattcctgagatcttatcgggaagctgctgatcaccagcttcagtttccctggtgctggctatgaccaattattattttagagaggcagtgtgacaactgcctaaccatcacctgatggtcacctgacatccctggtggatggaggaggccctcccctgccctgctcacacctgactagctacccactgtaacaaactgagaatgcgccactgcactacggcctggacggacagaaccagactttgtgctcccaccaaaa

SEQ ID NO: 381273 - DNA, 387 bp, Homo sapiens
cagatatcaaaatagctcatgaaacatgctttttggttctaacataggagaaaaatattaagagttgtgaaaagtgtgagttaagtgatctctctcattcttccagccaaaattatttttcctttgtttttttcactgagtatatgaagaactattgtgaaattctcaaactatgtttacttttctttttcttttttctttttttttttttttgagacagagtctcactctgtcgctcaggctggagtgcagtggcgcaatctcagctcattgcaacctctgcctcccggagaatggcgtcaacccgggaggcggaggttgcagtgagccaggattgtgcgactgcactccagcctgggtgacagggtgaaacgccatctcaaaaat

SEQ ID NO: 381274 - DNA, 358 bp, Homo sapiens
tagtagagacggggtttcaccatgtttgccaggctggtctcgaacccctggcctcaagtgatccacccgccgcagactcccagagtgctgggatttcaggtgtgagccactatgcccggcctaatacgtggatttttaaagcttcaggttctggttcagaagtttcctgggtctcattaaaataatgaggcactcagaattggtctaataaaaataacgaccatttctttctactccagtctctttcacaaacttcttagtgaaaatgacaagtgaggcccttcagtaggggcattttcagtggagataatagcggcagacctgagaccttgggctaggtagtttattctcatttctg

SEQ ID NO: 381275 - DNA, 1588 bp, Homo sapiens
tacttacggctaggtacgaggctgggtgttgaatccctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaa

SEQ ID NO: 381276 - DNA, 1130 bp, Homo sapiens
tacttacggctaggtacgaggctgggtgttgaatccgatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaa

SEQ ID NO: 381277 - DNA, 1034 bp, Homo sapiens
atcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgccggtacaccttttcgtctaagggacccatgtgggggcccctttgtctgtgtgtgccctatccagccggggccactgcggccaacgg

SEQ ID NO: 381278 - DNA, 885 bp, Homo sapiens
ggtgccctgttgcccggcacaccggatgccgcacccggcgtcggacggagcccatgcgcggagcggaaccgcgcgtggccgaccaaacggggatccaggccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaa

SEQ ID NO: 381279 - DNA, 319 bp, Homo sapiens
agcgaatgctctactccagctgcaagagccgcctcctcgactccgtggagcaggacttccatctggagatcgccaagaaagtaggcgccctccccagggcctcacctccccaggccctatcactccaatctccatgtggggcgctggggtcctgagatgacggcagagcaggaatcgttgctgtcgtgttgatcatagggcatctgaggcccaaggagcaacacgcatggcccaaggctgcccagctgatcggtggctcagaaaagtccaagtcctggctaccatgtcatgtcctttccctgggcctggagacagggag

SEQ ID NO: 381280 - DNA, 1719 bp, Homo sapiens
atcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaa

SEQ ID NO: 381281 - DNA, 903 bp, Homo sapiens
tacttacggctaggtacgaggctgggtgttgaatccctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgccggtacaccttttcgtctaagggacccatgtgggggcccctttgtctgtgtgtgccctatccagccggggccactgcggccaacgg

SEQ ID NO: 381282 - DNA, 2307 bp, Homo sapiens
atcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaagctggacctagagcgggaaaccattgagctggtgcacacagagcccacggatgtggcccagctgccctcccgggtgccccgagatgctgcccgctaccacttcttcctctacaagcacacccatgagggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaattgagattggcgatggggcagagctgacggcagagttcctctacgacgaggtgcaccccaagcaacacgccttcaagcaggccttcgccaagcccaagggcccagggggcaagcggggccataagcgcctcatccgcggcccgggtgaaaatggggatgacagctaggaggctggagcagggccggccacgtgtggactgtggggctgcccaccttccgctccctgccaccatcctccttcctgggctccaggaaagtgtttctgggaggtcaggagggctggcagctgaacgcacttgcagcgtccgagggccaccgggctggcattttgtgacccttccctgttgctgtccctgcatctcgtctgtgtgcccagggtgtccggggaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaaaaaaaaaaacaaaaaaaacaaaaaaaaaaaaaaaaaaaaaaaaaaaaaaaaagaggggggggcgcgcgcgcaaaagagaagactcccccgcggggggcgcccacaatgtcgcgcgcgcgacccccgggttttctggtaaacaagaagggggccaccacataagagagaggagcgcggaatataaaaagccgaaagagagcacagcgagcgcggcgcgcggagttataacaacagacacgcgcggagcaaggggggaaaaagcgggcaaacagcggggacaaactgtgggggaagaggagaaccctcataactcgcggggggggagagagcatcaattatgtgtggggggaagaaaaaataaaacacatcataaagaagagattataatagaaggcggtcaagaggaggagggaaaaatatataaaaaatcttctgaaaaagggggttaataataggggggggttgtataaaaccacaagggctggaataattattagtgaggggggatatagtgaaaaaattgttggggcaaaaagaagagagatagtagtattttgaaagaaaaaaaattatattataaccgggggg

SEQ ID NO: 381283 - DNA, 1058 bp, Homo sapiens
atcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccgtgcggctgaagatgctgtacgcggccacgcgggccacagtgaaaaaggagtttggaggtggccacatcaaggatgagctcttcgggactgtgaaggatgacctctcttttgctgggtaccagaaacacctgtcgtcctgtgcggcacctgccccgctgacctcggctgagagagagctccagcagatccgcattaacgaggtgaagacagagatcagtgtggaaagcaagcaccagaccctgcagggcctcgccttccccctgcagcctgaggcccagcgggcactccagcagctcaagcagaaaatggtcaactacatccagatgaccctgcctggctggcttaagggggctgggtcaggggcctggcatgaacctggcctcccggggagctgagactagggtcccagcacagcccagaaacctttggccacaagaagtggggtcagtcagggctggggcaggggtcactgcagtttgggatggttgaatgctgtattttctaaagaataaaatatttttaaatcaa

SEQ ID NO: 381284 - DNA, 655 bp, Homo sapiens
atcatccttagacccacccggaccgaggcgcaggctgcgcgcacgcgcggccccgagtccccgcctccctgccgcgcctgtcgggggcggggcgccgctgggggcgggtcctgcggcaccgcccgggaagctgcgcgagggtcgacagcctccgccacatcctccacctctcttggtccagcgagcgttgccgggccagggtcaagcggagggctccgacggcgcggacggagcgaagcgccgagccatggcgcaccaaacgggcatccacgccacggaagagctgaaggaattctttgccaaggcacgggctggctctgtgcggctcatcaaggttgtgattgaggacgagcagctcgtgctgggtgcctcgcaggagccagtaggccgctgggatcaggactatgacagggccgtgctgccactgctggacgcccagcagccctgctacctgctctaccgcctcgactcacagaatgctcagggcttcgaatggctcttcctcgcctggtcgcctgataactcccccggtgctgtgcttgtcatgagtgcctggtttctgctggctccactgctgtgtgtcacatgttggaattcaatggcagttttggatggtgggccactagttcatggattgagctcttcgggactgttc

SEQ ID NO: 381285 - DNA, 408 bp, Homo sapiens
tgttctagtaacacataataatcatgtttattcttttgcatggttactgatacgctaggattatcataagccaaaaataaaacttctgaacaaatggaaagaaaactgtcaatatccagtcccctctaaacatgaaaagatcagtttcaactggaattaagaccacatctctgaaacctttcccaagtaaatagagattgaagaagttggtgttataattgactacaccataacatttcccctttcccacaaggatcttaaatattaatgctcagttgctgaaaatctctctctcttatttctatttttgaacatcacaatctcatagactagaaacacacccagcctttgcacagcagaacatagggactggaatgccagataagaaatccagaaacttggctcctt

SEQ ID NO: 381286 - DNA, 904 bp, Homo sapiens
gacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacataattctcatttccataaaaaaaagaagggggggctagagatctggagggccaagttagggtccgttttgtaaggggccaagggggtttaaagaagggggggtaaagtggggaaaggggactggagacttcggggggcatggacccaataggcgaaaatggatggagatgggaaggatac

SEQ ID NO: 381287 - DNA, 746 bp, Homo sapiens
gacgactaactcaaaagagtgtgaactcccggctgcagacagttgtgctatcatggaaggagaagataatgaagaggaagttgtatattccaataaacagtcactactaggaaaactcaaatctttggcaaccaaggaaaaagaagaccattttgaatctgttcaactgaaaacctcaagatccccaaatatatgaagagacagtgctgtagccttgagactaatgaacaaagaaacctgctctagttttacaggaccatattttagggtctgtcctcatacctgtcacattggtgatctcacagaggagggccatgccgctgaaaagggaaggagattgaaacatttgattgccttatcacatggtcaagtaccttgccaaataaaggaaagcaaatgatttgggtctcaactgaagatgaagctcaactcaggaagagatttatctgtatatacacataactgaaaaccaagtttaagcccaccaatgcactgctgatgcatgccatataattaatgggtaacttttattctttatgatgtctacataacaagtgtgatttggaaggcacatgtgagcatatgcattatgatccaatttatgttttttctttgtttatattttggggaaaattaaaatttttttaaggtatatttttcccattatttattttcctgaccttaaaacagcttttctactaaaaaatggtgagcaatgaagacaataaatttttcatttttccata

SEQ ID NO: 381288 - DNA, 399 bp, Homo sapiens
cagagctcaggtgatcctctcctcagctacctgagtagctgggactacaggtgcacatggaatttcagtgttggtatatatttttctagtcagtgtatcgctgactctcccatcaacattgttggagaatgccctttaccaacgctggttattctgttgtaactgacttttatatgaagtttgagaatacagcctcttcagttgagatccatgtgtttgctgaatctcaacgtttttcccatgccagtctcctgatgttaatgctaatctaaaagatcaagtagctgaggccaggtgtggtggttcacacctgtaatctcagcactttgggaatccgaggcaggtggatcacctgaggtcaggagtttgagtccagcctggccaacatggtgaaaccca

SEQ ID NO: 381289 - DNA, 363 bp, Homo sapiens
tcttgttgaagggtttgctttattgaacggaagaaacagttctccctctcccctccacgctaggtataaccagccttccggatgtgccgcctttggtatcacccaagatctcgggatgggtacccatccctgcctccactgcctggtttgctggttaccctgctctttggttctgtttctccatgtgtgtttctgcaagctgcctcaatgtcccccttcctcggcagttgtcctactctgtgtcccttggtccccggtccgccgcggtgacacgagcccgcgccgccgctgccgctgccgccgtgccgccgcctcctcagcccccgccgccgccttccccgcaccatggagttctccgagagg

SEQ ID NO: 381290 - DNA, 495 bp, Homo sapiens
gggatggaaggggagggccaaggacgctacatggatgccgtgggacagctcggagagcaggctcagggcggattcacccaccacccccaggagggaggcctaggctggagctggagtctgtggaccctggggctgggaagggtggagtctgtagaccctggggcagcggggatccaagccccagggatggatcttgctctctcagcggggctcagtggggctgggggcagagaaaagtccccgtagcccgcacctgctccatcgactggagtggaggtgggctggggtagactgcagtcctccatcctagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381291 - DNA, 709 bp, Homo sapiens
  misc_feature (1)..(1): n is a, c, g, or t
  misc_feature (20)..(20): n is a, c, g, or t
nggccctgcacggaatggtngatcaacctgacttccaccttcctcaggaaaaaccagtgtgagacccgaaccaaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381292 - DNA, 948 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381293 - DNA, 806 bp, Homo sapiens
ggctggtaccggtcggagtgtatggatccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381294 - DNA, 1372 bp, Homo sapiens
gcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaaaaaaacaaaaaaaaaaaaaaaaaaaaaaaaaaaaaaaaaaaaaaaaaaaaaaaaaaaaaaaaaaaaaaaaaaaaaaaaaaaagagagaggggggcgccgcgcgccccaaccccccccgggggggcccccaactatcagcccaccccccccgcatttttttattaaaaagaaggcggcccaccactaagaggagggcgttactattattataataagcacgagaagaggcggcccgcgcttttataacacaacactgctaacagagcaggagaacaaagccggcggatcacgctgtcgagcaaaccttcttgtagatacagagcacccccactccctcattcgcgtcagggggggtggacacacatcaatgggggcgaccacccaccctcctcgacggataatataaaacgtcacctacagtggggcctaattataacacaattctcgaggtagtatagtgag

SEQ ID NO: 381295 - DNA, 332 bp, Homo sapiens
tcagctcgtactgactacatacttccgcatggcaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381296 - DNA, 205 bp, Homo sapiens
tcaagcttctaacgatgtacggggacatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381297 - DNA, 830 bp, Homo sapiens
aggatccttaattaaattaatcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381298 - DNA, 1411 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaaaaaaacaaaaaaaaaaaaaaaaaaaaaaaaaaaaaaaaaaaaaaaaaaaaaaaaaaaaaaaaaaaaaaaaaaaaaaaaaaaagagagaggggggcgccgcgcgccccaaccccccccgggggggcccccaactatcagcccaccccccccgcatttttttattaaaaagaaggcggcccaccactaagaggagggcgttactattattataataagcacgagaagaggcggcccgcgcttttataacacaacactgctaacagagcaggagaacaaagccggcggatcacgctgtcgagcaaaccttcttgtagatacagagcacccccactccctcattcgcgtcagggggggtggacacacatcaatgggggcgaccacccaccctcctcgacggataatataaaacgtcacctacagtggggcctaattataacacaattctcgaggtagtatagtgag

SEQ ID NO: 381299 - DNA, 969 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaatattataaaaaagtcgacgc

SEQ ID NO: 381300 - DNA, 833 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381301 - DNA, 969 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaatagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381302 - DNA, 966 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgactgcagtcctccatcctagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381303 - DNA, 1069 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacaagtacgtgccccgtggacgccgcccacacgcaggcctgaccagagggggctccccaagacccaggcagggcacacagcatcccccccgctgaggccagctccgtctccaccctgtcccagggccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381304 - DNA, 2056 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccaactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaaaaaaacaaaaaaaaaaaaaaaaaaaaaaaaaaaaaaaaaaaaaaaaaaaaaaaaaaaaaaaaaaaaaaaaaaaaaaaaaaaagagagaggggggcgccgcgcgccccaaccccccccgggggggcccccaactatcagcccaccccccccgcatttttttattaaaaagaaggcggcccaccactaagaggagggcgttactattattataataagcacgagaagaggcggcccgcgcttttataacacaacactgctaacagagcaggagaacaaagccggcggatcacgctgtcgagcaaaccttcttgtagatacagagcacccccactccctcattcgcgtcagggggggtggacacacatcaatgggggcgaccacccaccctcctcgacggataatataaaacgtcacctacagtggggcctaattataacacaattctcgaggtagtatagtgag

SEQ ID NO: 381305 - DNA, 1019 bp, Homo sapiens
  misc_feature (636)..(636): n is a, c, g, or t
  misc_feature (640)..(640): n is a, c, g, or t
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggggcccccttggngggncccgggaaaaggggggaaaacctttttttcccctgggcaattgggggcccccaaacccccccgttcttaacagccgaaaaccccaagaccgccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381306 - DNA, 1554 bp, Homo sapiens
gcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccaactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381307 - DNA, 871 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381308 - DNA, 651 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactcgacgaattccggcaccaccacgacgattccgcacgacgacgacgattccgcacgacgacaattccg

SEQ ID NO: 381309 - DNA, 746 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381310 - DNA, 693 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcagaaaaaccagtgtgagacccgaaccatgctgctggacgctctctctgtggggagagagggagggagagaggcgggagcctctcgcacttacagggagatgctgtaaagcaggggcacgctggagatggccagacccaggagaaggaccaaggggaaaaagaaattcgccgcggaggcccggaaggtgcgggcagccggggagcaggtggagaagagggacagctgtgag

SEQ ID NO: 381311 - DNA, 852 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagactggggcagcacctactccgtgtcagtggtggagaccgactacgaccagtacgcgctgctgtacagccagggcagcaagggccctggcgaggacttccgcatggccaccctctacaagtacgtgccccgtggacgccgcccacacgcaggcctgaccagagggggctccccaagacccaggcagggcacacagcatcccccccgctgaggccagctccgtctccaccctgtcccagggccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381312 - DNA, 325 bp, Homo sapiens
  misc_feature (33)..(33): n is a, c, g, or t
gctgtatcttgagtatcctggtcattggcaacncgagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381313 - DNA, 292 bp, Homo sapiens
cccaatggcagccgtgcccaatggcagccgaacccagacccccagggctgagttaaaggagaaattcaccgccttctgcaaggcccagggcttcacagaggataccattgtcttcctgccccaaaccggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381314 - DNA, 739 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaaggtgaggggctttcctgcgtcatccccaagggctacaggaccctgtcaggggaagggcactttccggctgggtcttccccctgggaggagtgagcgaagtcccgcagtgccgggcagtgccggccagggactgagcgggcgcgcaggaaggaggctgggtagccgcccgaggaggctgcccgcgagaagccctccctgggcaccgcgtcccgtctcccctgatgggccacgcagacaccgggccacacacgcgcccacgccagccagacacgtccacccctgtgggcacgcgacccccagaggacacacgagcgcacgttccacacctgggtgccaggacacgggcgggtggggcacagggatggcgacaaacactccgtgcgcggtgggggttgggagggacgcgcaccgcaca

SEQ ID NO: 381315 - DNA, 1059 bp, Homo sapiens
  misc_feature (437)..(437): n is a, c, g, or t
  misc_feature (492)..(492): n is a, c, g, or t
  misc_feature (529)..(529): n is a, c, g, or t
  misc_feature (711)..(711): n is a, c, g, or t
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaaagagaccagacaacccggcaaccgatcaatacagactaccaaaatcacgagatgacaatcagcgatatcgacaggctacgcaatcgacaaagcgagatgacctgaaataaataagaacaatctgaaattagccataagaacaagnacgaaaagttgatcccgcaggccggcagatatagaaggctcgactagccgaatgncctactgagccgagaccgacggataaataatccgagnaaaaaaaaacccagatgctcataatccaacaatcgggctccacagaaaacccgaccaacgccaaacaatgcaggcctaaaatgccgcgcgcataaaagctatcagccaagcaccataaacaatagaagaagaagccggacaagcaagccagggatacagcaaacatatcaatgcctgaagancatcaaaaggaccccgcagacgaatgaaccaaccccggtgaaaagcctcgccaacgaatctaatcgctgaagccccaggggccccctcaaaaaggcgaagcatgaacattaaagagagatgatctgactcgatcaagcgaaaagccccaataatcaacaccaagaaaaagaatctcatagaagaagaacccgaagcctccagagacccataatagaggagcaagagacttaaatcctagaaaggagcggccgccaaagggcaaaaaagcgaaatatagccgccaaccaatccaagagtaggaggcgcctacactactaagacaactcggaggacataatcaatgcgca

SEQ ID NO: 381316 - DNA, 1293 bp, Homo sapiens
aggatccttaattaaattaatcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaaaaaaacaaaaaaaaaaaaaaaaaaaaaaaaaaaaaaaaaaaaaaaaaaaaaaaaaaaaaaaaaaaaaaaaaaaaaaaaaaaagagagaggggggcgccgcgcgccccaaccccccccgggggggcccccaactatcagcccaccccccccgcatttttttattaaaaagaaggcggcccaccactaagaggagggcgttactattattataataagcacgagaagaggcggcccgcgcttttataacacaacactgctaacagagcaggagaacaaagccggcggatcacgctgtcgagcaaaccttcttgtagatacagagcacccccactccctcattcgcgtcagggggggtggacacacatcaatgggggcgaccacccaccctcctcgacggataatataaaacgtcacctacagtggggcctaattataacacaattctcgaggtagtatagtgag

SEQ ID NO: 381317 - DNA, 980 bp, Homo sapiens
  misc_feature (959)..(959): n is a, c, g, or t
  misc_feature (962)..(962): n is a, c, g, or t
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaaaaacaatganganaactctcccaggagcctg

SEQ ID NO: 381318 - DNA, 909 bp, Homo sapiens
gcggggatgtgaggggcggggtcatctcctggggcggggatgtgaggggcgtggtcagctcctggggcggagatgtgaggggcggggtcatctcctggggcggggattgaggggcgggggtcagttcctggggcggggcgtgaggggcgtggctgctcgggggattgggcgtgggggcggggccgggttggagaccggaggagtagacggcagaggcgcccccgcaggtaggcgcaggtgggtccggagggtcctggccgacgcgggtgggggtcgctcgccgcagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381319 - DNA, 837 bp, Homo sapiens
  misc_feature (22)..(22): n is a, c, g, or t
cagctggtacggccggggtttntggattcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381320 - DNA, 1181 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagtaacaaaaaaaaaaaaatatattataaaaaaaaaaaaactgagggggggcgggtcccaatttcctattaggggcgtaacacattaactgccgccttttacacgtcgaactgggaaaacctggcgtcccaacttattcgcttgggacaatccctcttccacgtggggaataccaaaaggccgaccatcgctttcaacaattgccacctatgggattgcaacttaagcgttatttct

SEQ ID NO: 381321 - DNA, 918 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctgccattgggcgggatcctctagatcaacctcagaaca

SEQ ID NO: 381322 - DNA, 1101 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381323 - DNA, 1593 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccaactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381324 - DNA, 1050 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggagactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381325 - DNA, 846 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacaataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381326 - DNA, 700 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacatatccgaagcccgatccgaagcagtggccagagatcctcta

SEQ ID NO: 381327 - DNA, 1491 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctcccacggggaaacctcttcacttccggttctggcagcgacttctgcggctgcaccaggaatcctggttttctgagcctggctcccccagattctggtttggggacagggttcacaggctgtgcaggcgagagcagggcactggctggagagcagccgggtgggggagcatcccgggccagccgaggggctgagtgcccccaaagcccacaggtgcaccccttccctgaagcagaggtgaggtttggggggctgagtccccgacagggttgtctcttgggttcccaactggggcagcacctactccgtgtcagtggtggagaccgactacgaccagtacgcgctgctgtacagccagggcagcaagggccctggcgaggacttccgcatggccaccctctacaataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381328 - DNA, 931 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccgtgagtggggcctccaccggccccctgggcccagcctgggggcgacacttgccgggacgactctgggccagccccctgccgcggagatccatggggtgggaggtgatggctgccccaccagcgtcagaggcaaaggccaggcctgggcgtgactacccatgcacaagtgttagggacagagagacccttcctccagggggttggatcctctctggagcccaccattgtcttgtcaggccccttccctgccctctggagttttccccacataagcagccccccaaggcccctccatatgcctcctcccaattctcctccccaggacccaggggtttcctcactcccacctggggaatggctccggggatcctcaagtagctagaaaacct

SEQ ID NO: 381329 - DNA, 851 bp, Homo sapiens
cgacaaagaagccattctgcgtcctcttctccaagtcctagtagggtgacgtcgagaacaactccacggcgacaaggatcagtatctccctgctccaatgtggaatccagattgttgccaagatacagtcattctggctcctcctgcacacctccctcgctctcccacaccactggcaccaggccccggacacccgctctgctgcaggagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgactgcagtcctccatcctagcctttcggtcacacccctcaggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381330 - DNA, 578 bp, Homo sapiens
cccaatggcagccgtgcccaatggcagccgtagccgtgcgggccgcacgcgttagtcgccctggccggcctcgtcacagggatacccacccaccatcccagggtctacaacatccacagccggaccgtcacccgctatcctgccaactctatcgtggtcgtaggaggctgtcctgtctgcagggttggggtgctggaggactgcttcaccttcctgggcatcttcctggccatcatcctcttccgcattgggccggctgccattgggcaatggcagccgcccaatggcagccgaacccagacccccagggctgagttaaaggagaaattcaccgccttctgcaaggcccagggcttcacagaggataccattgtcttcctgccccaaaccgataagtgcatgacggaacaataggactccccagggctgaagctgggatcccggccagccaggtgacccccacgctctggatgtctctgctctgttccttccccgagcccctgccccggctccccgccaaagcacccctgcccactcgggcttcatcctgcacaataaactccggaagcaagtcagta

SEQ ID NO: 381331 - DNA, 491 bp, Homo sapiens
ggggtgagtgttcaagtcagaacctccctcccgcagccccttcatgaggagccccctccatgggggacatggagaccaggcgcccactctgtgccaggccccagcagctcccaggatgtggggcttcagcctggtggggggcatagggtagagggtgcccatgggggatacaggggaaccaaccatactgggctcaggcacagcctcctaggggtggacagcctgctcttggcagaggtggagaaagaccctctctttgtttccagtgcccagggagaggtgggaggtgatgggggatctgtgcagtttgggggctcagtcaagacgagctctgcgttacgggaggaacaggaagcccagtgggaaaattggcctaagtctggggttctgacgacagcccctggcttctttcttggcagataagtgcatgacggaacaataggtgagccactccattcattcattcattcattcattcattcattcattca

SEQ ID NO: 381332 - DNA, 390 bp, Homo sapiens
aaaatatcattagtacagcaaatttttaatgaggctaagtctctgtttcctcacctgttacactggaaaacaataataatgatatcctgtgaaattcagagggttgctggtcaaaccatttaaaaagtgcacatgaaagcatgttggggagtctaatgctctgaattggtgtcagtattgattttgttaccgatggaaagaagacatgcagataacccaaaagaagcaattatcaaggctgattctgacagccattaagttaaaactctagatggagctttactaagttgtcttgacattaaaaagaaatgaaaacttaaaaaaaaatctgagatatattcataggtcagtctaataggaaaaagacagtggacattttccatcccatcg

SEQ ID NO: 381333 - DNA, 472 bp, Homo sapiens
tcatctgagtggtttggggaacttcaagcattagcctttgaaataggattagttgaagtcatgcagtgcttaggtcagtatcctggctcctaattgggaactgtttccaacaccccacctgctacatcttgcagtgtggcaccggacaggatgaaacaacaatcctctctggagaaggatcccccatcttcttaggcctcaagctatttctacagattactttttaagtgcaatgtccagcacaatcagagatcaccaggctaccaggagacaagacatgacgtgtgagaactaacaaaaggagtagaagatgccctatgtgattaaatgagataggacacatgatcatgctttctaaagcttttaaaaatactataaggttgaatggtagaaaatctcaaagacgaagatttagtgtttttgttctgcactgtgattcactgtgagaatttttatcttaaatagagaacta

SEQ ID NO: 381334 - DNA, 344 bp, Homo sapiens
gattcagcacttgaaccagccactttctaaccatgggcacttggcaagtgaactgattctctgagattcaacttcctcatctgtaaaatacaggtaatacctacttatataattatcatgacaataagagagaagcctactgactggtggataatagttcatttgcaaaaagatttaaatgccaactatgtgttgtgaagtagaatagatgctagatataaaaaattaaaagatatcgaagccattggggggtggtcaatgccctcatgtagttcatgttgtcctgggagtggggatacaacaagaaataaacaactcaataaaaagaaatcattaaaaatgtt

SEQ ID NO: 381335 - DNA, 214 bp, Homo sapiens
ctcaatttcttctcatcttttttatgctattattgtcatataagttacattcctatacattgtgtgtccaacacaaatttaaaattatgccattgtctcttaagtcatagaacaaaagagatacaaacaaaacatacatttatcctgtcttttatatttgcctatgcagttacctttaccagtgttccttatttcttcatgtggatctgagtta

SEQ ID NO: 381336 - DNA, 833 bp, Homo sapiens
tcagacaacatagtttctgttttcaaagttagaaggaaatgctgtaagctaatgcctggtaataatagttttgattctgactaaaaatctaaagtaaattattatagaggaagattatgaatacttaaatttaaaaagcagtaattactataatctgtcattgataggattcccaaatacaaatgatacttaacattgtttattgaagcaaattgttattatgattgttcttagggattaaatggggaaatataagcttaagtaaacctaaaaaataatggccagtagggcattggctacctatggggagtctgttagtattagatatcttctcagctttgccctgttcaatatttttattgaactggataaggagttaaaatacatactaatgaaatgtgtcagtgacaaaaagctaggaattctgtaagacttgtggatggtagaattagaatccaagaagatttcaaaagattgtagaaaattgactgattcaagaaattgtgaaaaaataaatgcatgtcccacccatgcgtttaaaaattcaactatataagtaaaagatgagagagacacagttttgaagcagcataagtaagacagattataatcaataaacccagcgtgagtcagcagtgtcacttgagtaacagaaaacaggtacatgggagtttctcctagtatgtgtgtgctattttgagtaagaatggcatatttggtgataatacccacagattagaccttcctgggaatattgcatttaattttcggtgtaagcatattaagtggagagtgtcttaagatagtatgggaaagagaagatgtaaaaaaaa

SEQ ID NO: 381337 - DNA, 415 bp, Homo sapiens
ccagtgtttcctggaatcaactctaaatcaaccacttgccctggaatccctgtcgcagggtctagttctgggagcaaaaactaagggggtaacaggtcctacttattatgggctgaattatgtcccccaccaaattcccatgttgaaatcctaactcccagtgcctcagaatgtatttagaaataaggcctttaaagaggttactaagttaaaatgaagctgttaggatgggccctactccaatatgacagatgtccttataagaggaaatttggatacacagagataccagggttgtgcgcacacagaggaaaggccatgtgaggacacagtgaggacagctgtctgcaaaccaccaaagaaaccaaacctgctgacaccttgaccttggaccgccagcctccagaattgtgag

SEQ ID NO: 381338 - DNA, 640 bp, Homo sapiens
gaaccttcactgcaatatgcctgtgagggcgcccccagtgacgtggcataataacacccttcaagttggccctgaagcggggtgaggtttccggacccagacctgcaaattgtgtcagcaccttggagcctccgaatctctcagcaggcagtggcatgtgtgcgtcttcatgggtgcgtgcatgtacatgcagcaagtttcgctgaagattcaagttagtgaagggcatttatgtcacagcactgtgaaaaatttaaaattaaatatgacatttcagttcataaaaattctttggcccatctggcccctggaatttctccctggcctcacttcccttcaggtcccagtcacctgtcagtctgctcagagccctcttcctcctcccccctccactctgcatgttcatcccccatgctcaaatttcccacaagttctgatgctgaacagattagccatcaaccagacagtctttgtgcttcctgtattctctggatacatttcgcctttgttctcatatattatatacatactacaatatctgtttttcaaagtcccagtgggaatagagcaagtcaaaggagggctgacacttgtaccagaatattaaagaccaggcaaccccatctccaggcccccatgg

SEQ ID NO: 381339 - DNA, 505 bp, Homo sapiens
ctggtaagtatgtaaggtaatgcatatgttaactagctcaatttagccattccacaatgtattaaagatccagagctgcctggagaaatggctcaatccaggtctcgaggaaaaaaactgttcaaaatgaacctggagtgtcatatccaagaagatagcagagaaggtcatgtcaaaaggactcaaggtgaacttaaagatggaacattttagccaggtgcagtggctcatgtctgcagttgcaacacttaaggatgccaaggcaagaggatcacttcaagccaggagtttgagaccagcctgagcaacatagcaagacctcatctctacacaaaatacaaaatttgccaggtgtggtggtgtgcacctgcccagctacttgggagggtggggtgggaggattgcttgagcccagggggttaaggttgcagtaagccatgatcttaccattgtactctctagcctgggcaacagagtgaaactctgtatttaaaaaaaaaaaaag

SEQ ID NO: 381340 - DNA, 419 bp, Homo sapiens
cattgcatgggcaatgaacagaatatgtgtcatgcagataagaataagtaaggagataactaaatgatttggtcaatgtctgcgtgaagaaacaaacaaacaaaaaagaactatttgggagccctgtttaagaagggggatatttacagactattgtgattctggggctgagaaagacactattcttgtgtttatacccctagagcctttgattgaactcgaaagctcctgtctgctttttgttttcattcagagtagtaaatacctttgtttccctttacaaataagaaaatagggagaggggcaaaagaaatagaaatgttctatctatctaagtttttaggatgtcaagaattttcctgacattaggagaaacttccaccctgtatggcaaacacctgtcaatgatggcactagca

SEQ ID NO: 381341 - DNA, 434 bp, Homo sapiens
tatgcgcctggcacaagtgtacactttaaccctgtgcagtcagcaaccattctaagaagcaagtctggactgccagccagccaggacctaggatgtgtccttggggttgctgccagcatcatcattgtcattgtcaccatcactgacatttattgagtgctcactgggaaccagccacggctccaagtgtttttgcctgtgaaccctccccagtctcacaattgcatgaggttggggccgtaactatcctcattaaataaccttgggaggtggtatcatgcccagggtcacagaaccccagaactgggttcacggcctttttatgatgctgctggcaatgtggagacacaggcctgcctcagggcagaaacagcccctgctttgaaggtgagtttgatcctgagaagaaagtgatagaggaggagagagagagg

SEQ ID NO: 381342 - DNA, 395 bp, Homo sapiens
tgggtaaatctgaaacagactatgagcagagaaatacaacagagactgaaaacttctgggaagaagcagggatgagcctcttagggaaaatcagaaatccaagaagagctgtatagacattaataatggtacttccacaagccagaagaaacacatccccagaaaaggactgagtgttcccacatgtaggaagctgaaggcccaagagatgtgaccagctcaacattccactggaggctttatgatcaaacaacaaactatcatgaatgcaggatgtgggcaaactcacgactgcgcctgacaccagaaggtttgctgaaggtaatcactccctggtgccatgctcattgaaattatctactgggacatctacagtctattgttcaaagaatgca

SEQ ID NO: 381343 - DNA, 257 bp, Homo sapiens
cctcacaccccaacctgcagccacacttggttcaatcccactgtctagcccgtctgactcagtagcccctcccgagggagcagggctaagcaaagctggtttccccactgcaaggcactgcaggccattctattctgggccttctcatccttcataaagtgaggaggcctgaacagggctccccactagccccgagagcacgcaattcctgaagatttccaggattttcttaatatcagttatggcttacggttatg

SEQ ID NO: 381344 - DNA, 352 bp, Homo sapiens
tacaatagtgtagtcactgtggaaaagtttgtcattgcctcacaagcaaaaagttaaacatagtttctatattgcccagcaattccattcataggtatatacccaattgaaaatctatgtccacacaaaaacttgtactcaagtgttcattgtagcttattcataataacaaagaagtggaaatccacaaaatatctatacaatgaaatatcgttcagccataaaaaggaatgaagtactataacagggataaacctagaaaacattatgctaagtgaaagaaaccacacacataaggccacataattgtttgattccatttatatgaaatgccaaagatagccaaatccat

SEQ ID NO: 381345 - DNA, 783 bp, Homo sapiens
cgagtggatacctgaggtcaggagttcgagaccagcctggccaacatggtgaaacccccatcttacttaaaacacaaaaattagctgggcgtggtggcaggcgcctgtagttccagccacccacgaggctgaggcaggagaatcgcttgaaccaggtaggcggagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381346 - DNA, 2491 bp, Homo sapiens
  misc_feature (818)..(818): n is a, c, g, or t
atctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaatcgcttgaaccaggtaggcggagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381347 - DNA, 2633 bp, Homo sapiens
  misc_feature (676)..(676): n is a, c, g, or t
catgggtccaaagcagcgcaaagttctcagagtaggttgcaactcatacagtcctcaagagagtgcccttacagggccaagcacacaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381348 - DNA, 2707 bp, Homo sapiens
  misc_feature (750)..(750): n is a, c, g, or t
cagggtgcagcgcaatcagatgttgttagttgatgagaaaaagcacgaaatgatttctagttgattcattgaaataaaattttttccaaaggacaagaagctcccatcccagtaaggcaatgcaagaacctgaagcaaaatgcacctgaggcttacagtggggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381349 - DNA, 2864 bp, Homo sapiens
  misc_feature (676)..(676): n is a, c, g, or t
catgggtccaaagcagcgcaaagttctcagagtaggttgcaactcatacagtcctcaagagagtgcccttacagggccaagcacacaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagatagggtttcccaatgttggtgaggctgatctcaaactcttgacctcaggtgatgcacctgcctcagcctcccaaagtgctgggattacaggtgtgagtgactgcgcctggcctgtaaaatatatcttgacctagatcacagatgcaatgattactctcatacctcacagtatttaataggagagatgctctctcttgctctcgctctcttttttctttttttttttttttgagacagttttgttcttgttacccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381350 - DNA, 2013 bp, Homo sapiens
cagggtgcagcgcaatcagatgttgttagttgatgagaaaaagcacgaaatgatttctagttgattcattgaaataaaattttttccaaaggacaagaagctcccatcccagtaaggcaatgcaagaacctgaagcaaaatgcacctgaggcttacagtggggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381351 - DNA, 866 bp, Homo sapiens
aaaaaaaggttgtgtcatattcctggctaaaaacccagatgatgtgactctcctctctccctattcataggcaggattgtaaaatttctttttttttttgaacatttcttttgtcacccaggctggagtgcagtggcatgatcttggctcactgcaacctccgcttcctgggttcaagcaattctcttgcctcagcctccttagtagctagccaccacacctggctaatttttgtatttctattagagattgcagtgagccgagattgcgccactgcactccagcctgggtgacagggagactccatctcaaagaaaaaaaaagtgaccttttgcagcacatagctgatttgactgctttgtggagtacaccaagcaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381352 - DNA, 2810 bp, Homo sapiens
  misc_feature (676)..(676): n is a, c, g, or t
catgggtccaaagcagcgcaaagttctcagagtaggttgcaactcatacagtcctcaagagagtgcccttacagggccaagcacacaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagatagggtttcccaatgttggtgaggctgatctcaaactcttgacctcaggtgatgcacctgcctcagcctcccaaagtgctgggattacaggtgtgagtgactgcgcctggcctgtaaaatatatcttgacctagatcacagatgcaatgattactctcatacctcacagtatttaataggagagatgctctctcttgctctcgctctcttttttctttttttttttttttgagacagttttgttcttgttacccactgcactccagcctgggtgacagggagactccatctcaaagaaaaaaacaggttgtcaaactggtggtccctttactgaaattttatttccacaatggtgttggaggggcagcagcagaatccgtgccttttcttctggagtgtgtgagagtccgtggtcctgagtatctcacacagatgtggcaatttatgtgatgttctgattaagaccattggtacagaaacagtttcagatgtcctcagaaataatgcattgtttagcaaagtgcattgaagttatgggagatggatgccttaataatgaacactttgaagaacacctttgccacatgtcctcaggaccttctgagggctgtgtcatggggcatggtcactcatatttgactcaataaatttcttcaaatattttacaaaaacaaacaccgacataaaaaccaaaaacccaaaacgcaacaaaacaaaaaaggggggggcgcccaaaaaaaacccccggggggggccacactacaacaccccctttttttaaaaaaggcccccaa

SEQ ID NO: 381353 - DNA, 2270 bp, Homo sapiens
  misc_feature (676)..(676): n is a, c, g, or t
catgggtccaaagcagcgcaaagttctcagagtaggttgcaactcatacagtcctcaagagagtgcccttacagggccaagcacacaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacatatattacgccctagtgtgttacagagaatgtcataacagggcccagcacacaagtgagattgtgtttgtcctatgcacactacaccaacctttacagttgtcaccctgacccattgacagagtctgctagtgaggttctgaattacatgtgaacacagtccgcagttggaattgtgactgtcatatgtgaacatctggctacagttgggatggtgactcatttctaaatccagctnataggaaggtgaagactctcctatctggactcagttggtgagagagatgttgactctcatatctgggcttagaaccacaggaaagattctggagctccttgtgcaaaggtcatagaggattatcaatcttgcatattgtataaagtcctcaggtgacacagagtgtctctcgaatgcacacccaggcaacagtaaagattgtcattctcccacataaacacatcccactgttgaagttctgaatttcacagaggctgtcaaaagttggataattgcctctcatgtgtggatctggtccacaggtgggttagtgacttccagaccaaggttcagcgcacatgtaaggctgtgactacactaagaagatacagtctgcagaagaaactgtggctcttttgcacacattctgtcaatcattgtgattgcgactcatgtacttagacccaacatacaggaggtgttgactttcatacctttagaacctggacatgtttggaatttctaatctaatccctggactttcctgcaggtgtgattgtgtgcattgcaaagcaccttagtgatttgactctcctgccttggccaagcacacaaatgagattgtgacatatggcttgactctgaacctccaagatgtgactcttttttccagccttggagctgcccacatgttgcattgtgacatattcctaagccctgcactcaggttatgtgactctccttttttgcttaggccctgaatatttttcatgttaagacatattactaggtccaacacctataaaatgggagactaccacctgggctctttctacagagggccttgtgacatacctctgcatcaataacctaggagatgtgatgctccatttttgcctgtacgtgccccacagaaaaaattgtggctggcccaggtaccaggtgatgtgtctctgctgcctgggcctggaccacagagagcattgttactgattgctgggctcagcacccaggtgatgtgactctgctgcctgtgtgctgctttcaggagaaggttgtaacttattcctggctgagtatgcagtcacactcctgactgatctctgccctcagaaaaggttgtgtcaagccgggcccggtggctcatgccagtaatccccagcacttggggagaccgaggtgggtggatcgcctgaggagtttgggaccagatggccaacatggtgaaaccccgtctctactaaaaatacaaaaattaatcgggtgtggtggcgggcacctgtaaactcacaattctcttgcctcagcctccttagtagctagccaccacacctggctaatttttgtatttctattagagatagggtttcccaatgttggtgaggctgatctcaaactcttgacctcaggtgatgcacctgcctcagcctcccaaagtgctgggattacaggtgtgagtgactgcgcctggcctgtaaaatatatcttgaccagcctgaccaacatggagaaattctgtccctactgaaaatacaaaattagccggatgtggtggtgcatgcctgtaatcccagctacttgggaggctgaggcaagagaattgcttgaacccagg

SEQ ID NO: 381354 - DNA, 418 bp, Homo sapiens
agagcatgtcatcataggacccagcaaacaggttaaatcatgtttcatgtaagcgctccctgacaatttttagaattgtcatcgtcacacatggtgaaagtccactgatgaggtcataattctcatgcacagatgcagtccacagttaaaattgtaactatcatatgtaaacgtggccacagttgagatggtgactcatttctaaacccagctcataggtgagtgaggactctcctctctggacccagccaattgaagagatgttgacccatacctagacttaggaccacataagatcatgggtccaaagcagcgcaaagttctcagagtaggttgcaactcatacagtcctcaagagagtgcccttacagggccaagcacacaggtgagattgtcaaacttacattcacacccagtc

SEQ ID NO: 381355 - DNA, 3305 bp, Homo sapiens
agggttctcttggagccacctctcagcctgcctctgcagctttgtcggttaactgttcctacaaatgaaagacacaagccaataaagccagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccacatatatgtgaagactgtagcaggaagcgaggaacctgtgcatgaccgttaccgtcctactatagaaatggaaagaaggaggggattgtggtggcttgtgcccagactgagcctggaatgatgcagctcagtcaaggagcagcagacctggcactggaacagggttgaaaacccagggttttgtacttggagaggaaagatgccaagctgcttcttaatcaatccaaatttcatttacagctctggaacactttggggctgatttgtctctttaggggacatccccaacatggttaattccaactctcagatcttgtgctttagttagtacatgtgactcaccagatggggtccttagatcctattcctgctcccagtgggaatttgcttttctttgtcattttgggaaaggggcttggtttctgagtgtcttgccttctcatctttttttttcatatcctttttctcaaaaaagccatcagatctgactttcatggaagtgttgctgaggtcagcctggtgcaagttgggatacaaatgaaacttatgcaggatgtgtgagaggaagcagttaattgtttctgaatatctcagggtaggaaccatgtggagccacacattccctgaccacagggaagcacctggctcaatcatgtcacacagcagtggaaagaatacggactcttaagtcacacctaccactgagcagctgtacgactttggagaagttgtttaacattttcaagcctcagtttttgcttttttaaaggaggggaaatatttgcctcatgtcataattgaaaagattaaataagaaataaagggaagtgtctgctacttagttgccagtcaaaatgttagttctctctctctaccaccttcctcctacctcttcccatattgcttgcctgataaaacagctaatcaccagcatttgttccccatagtcacagggccacacaagggaacatttaggacaaactttctccatggcctatgatccaaattgttatctaaagatgattctaggtgttgctggtagtatgtgaatcttccaatctaggtgtgatcgtgtcctcatatgaatcaggaaaaggcagtttcttacaagttccgaattccaaatacagagactggtggtgttacatttaaccttaaagatgttaatgttgatggaaattcatgtttcatattaaaacaacactttgtctttacaatgaaacattttgcttaatttttaaagtaagacattatgatacctctgatggcagttcctcaaataactttaacttttgtgctttagggatagttgttaaagttacaacttcttttattttattttttaaaggcttcagattaaacaagagcccttaagcccacgcatagcattgccgcttcagcttgctgaggactgtctccaaggaggccaaatggaaaaggagaggctacttcaagtggtgttggcccattgagcctattgggcaaactataaccaggttgccttattttgggtggattactccaggagaggccaccctccagctttctcttatcccagtaactcctcttcccattttccaatccatccccagccattttttttttttcttctgtactcttcttttgccttcaatatgagtttcatttcctctgtgtctttgggcagacttccttctaacatgtgtcagctaccctaccacacacctggcctaggagacacatcattcattgctcctacttgtgtctgtaatcagagagtatttaaggagggcagttctgcgacggactgtgtgtgtgttgaaagtaaagatggggggccgcggggaaggcaagagtttttccaaaagattattagaaatgagggctgtatctactctgtggagtagaaccaagtctacttggagaaaagaaccaagtccttgggatatctaggggaaagctgtttggcagaaagaaaaatcaagaggacccaaggggatggagacaggaccacaggaatgggccaaggagcaacgtgcctgccattcagccagcttgggacaggctttcactttcactcccatgaggaggcttccaggcagcctggttcccccatgtatagccattgccctctagcaggccaggcctcccagtgggaaggcctgggtccagggcatcttaagttcatccagcagctccatgagccacacagatatcctagaaaatattcctttctcacacagggcttctgattactcagaaacatgcccctcttccctgaataaccaagaacatgttctatgaacccaatctctgccacatgtcaatacctgctcttcaaagccccttttgaaactcagttttgtgccaagtcctctggatctaattaccttaaacaagcagatttagccatttttaaacagacattcccagtcatcctggtgcttgtacttctcctacatgtcatgaaggaccttggatttactgagaactcagccgtggccttggctttgatacttataggtgtcagcccttgggccgattgttgatcatccagagcctcagttctgtacttgtaaagtggagacagcagttctcatcctccatccttttagcccatggggtggttgtaaggctggattgaaatatgcatgtgactaagccatgtagctataaagtgagggatgacttgtgttttggatcacttattttaattctacttataatccacggcttagaatatttaaacattgtttctattaaactagaaaggttcagcatttctgtcatttacttctgctatgatacacaagaacttatgttggaatgaagtgaaaagtaaaatggccattcttatgaacctacaaaaaaa

SEQ ID NO: 381356 - DNA, 1728 bp, Homo sapiens
agaagggagcgagagcccctgagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacgggccattcacacaggcggtgaaagtcagcctgaggatttagcccagaggtgatggagcccctgaagggtgtgtgtggagggcagaggagaggggacaagacagggggacggctcaggaggctgcggcggggcaaggccagtacccggtggccttcagcagagcaaaggaggtggagcacaagctggacctctgctggaaacagcaggaatgacttcagccttggggcagctggctggcaggatgcagacacaccatgggtcctgttaaggccaaatctgcttcgggcaccaagatgtcaagaggtgctagacttggagtttgtcctggcaggtgatatggcaaagtgtcaccagagcctgccgtgggcacgaatgtgtggggcagagaggtttccaggcagtgagaggtggcagctgagctgagccaccaaggatgggaagggctggagctacagagatggagagaagggcccttcagcctttgggaacagggtcagcatccacggcaatggtgccattccagacactgcatgtgtcagcctcatgactacaaaccagaccagatgggcttggctattgtcatgcccaagaagccacagctcagagaggtttggtgacctggccatgaggacagagctggtagtagagctgggcttcagacccaggcagcccagccctttccatgagctgagtctctgcctctgcctctcccttccaagctctgcccatgtgtgtggccagtcagatggtgaaggaacttaaaccacataaaaaggccagacagggcggggtgtggtggctcacacctgtaatcccagcactttgggaggccgaggagggcagatcacttgagatcaggagttcaagaccagcctggccaacatggtgaaacccccctctctacaaacaatacaaaaattagccaggcatggtggtgggtacctgtaatcccagctactcaggaggctgaggcaggagaattgcttgaaacccgggaagtggaggttgcagtgagccaagatcacactactgcactccagcctgggcaacagaacaagattctgtctcaaaaaac

SEQ ID NO: 381357 - DNA, 645 bp, Homo sapiens
gttgtcctcctcaccttcacccaaatctttaattcacggagctgcatccccttctttggtttcagatgttcctggttcgccgggacagcagctcgaagcagctggtgctctgtgtccactttccttctctgaacgaaagctcggccgaggtgctcgaatacaccattaaggaagaaaagtcgacattccccttttcagcctccaacactggagttgggccaggaaaaaaatacatcatgagataatttaactccaagaactttattgtaaaacttcagtggtgaatttcttttaaaaaaaatagatcttgaatcatagtggtgtattcttagcctcctttttttttcacttagacattttattatgagctttctctgtgttattgaacatttcaaagactttgcaaccaattaaatatgtgttggatggcttctgaaggaagacagtatgacaggcttgaagacagggttcttggcattgaaccagtgggagagacaggctcatgcatacataaccagaaatacaagtcgttcgaactgtcctaaatgttagaatgtaagcatgtactctgggtcatcaaaaccaatgacactcagggaaatccacccaggcctactttgggccttggacgatggaaaatatttg

SEQ ID NO: 381358 - DNA, 3696 bp, Homo sapiens
agaagggagcgagagcccctgagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaatgaaaaat

SEQ ID NO: 381359 - DNA, 3878 bp, Homo sapiens
agaagggagcgagagcccctgagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacagggactccgagacgcgccttaattcatctcccagaactgtcggcccagctgggaagccaggcagggagggggacgggccccccgcaggctcgcggcagagacgggaaaggcgcaggtgccggactcgcagacagcttggcgcccgccacccgctatccatccagggaggggcctgggccgggagagggcgcctgaggagacagggccccgccgtgaccacaggcccctcgcgtctccgcaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaatgaaaaat

SEQ ID NO: 381360 - DNA, 2193 bp, Homo sapiens
gcccagagctggacagtcactagcaggtggatagtgccctgggaggcctaatggaggacaaggagccctgaggcagccactaagacggagggagtgggccgggcttttcccctcctggaagaaatgggcggtccccgtgaagctcttgacaggagcccggcctcgcctaagccctagccaccagttgccatcacggtctccgccgagccgggatcctcagccgcttcccgcgcaggcctgctgttcccaatccggccacaaaggggcagccccgcgcgcagcctctctgcctgcagccctgagccccggggaaggcgaggccgctccgggccggagcttccagcgcctgctcgcccatttatgggaggcgggcgctatccccactttacagccggggctcgacgaatcaaggccacacaggcagtgggagcaaaggcaaagcccggcaggtgtggggctgggtccctaggggtggaggacggcgggcgggcgccctgctcgtgctgcgagtgcccagccccagcccgcaggcgtcgcctcgccttgcccgccctgctcatgccgggccttccccaccgactgcgcccagcctccttcacccggtcccctcccgctttaccaatccctgccccacgcagctcctcagagccccagggctcttgcagccctaaggggctggactgtgttgcccgcccgcactatgggatgcccgggcgggctcgcacctcccttcttatctgtgctgccctccgtgcccagcattgcgcctggggtgcagggaactcacctggagggagggagggagggaatgaatgaatgaatgaatgatggggagcctgtggaccagcagccaggggacgcgccggctcctctttgcagggactccgagacgcgccttaattcatctcccagaactgtcggcccagctgggaagccaggcagggagggggacgggccccccgcaggctcgcggcagagacgggaaaggcgcaggtgccggactcgcagacagcttggcgcccgccacccgctatccatccagggaggggcctgggccgggagagggcgcctgaggagacagggccccgccgtgaccacaggcccctcgcgtctccgcaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaatgaaaaat

SEQ ID NO: 381361 - DNA, 981 bp, Homo sapiens
agaagggagcgagagcccctgagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgacattccccttttcagcctccaacactggagttgggccaggaaaaaaatacatcatgagataatttaactccaagaactttattgtaaaacttcagtggtgaatttcttttaaaaaaaatagatcttgaatcatagtggtgtattcttagcctcctttttttttcacttagacattttattatgagctttctctgtgttattgaacatttcaaagactttgcaaccaattaaatatgtgttggatggcttctgaaggaagacagtatgacaggcttgaagacagggttcttggcattgaaccagtgggagagacaggctcatgcatacataaccagaaatacaagtcgttcgaactgtcctaaatgttagaatgtaagcatgtactctgggtcatcaaaaccaatgacactcagggaaatccacccaggcctactttgggccttggacgatggaaaatatttg

SEQ ID NO: 381362 - DNA, 781 bp, Homo sapiens
catgcttgagcccacgggcacagtttgtgagatgtaatcgagaagatgctgatcaccagttttcagcagagtttgtgaaaggcagcagaatcccgctccccatgcttgccttcgggaccctcactggagcagaaccattgcttagagcgtgagaaggagaagcgagtgtccgtcaacatgctggctctgggtgagacctcgatgttcctggttcgccgggacagcagctcgaagcagctggtgctctgtgtccactttccttctctgaacgaaagctcggccgaggtgctcgaatacaccattaaggaagaaaagtcgacattccccttttcagcctccaacactggagttgggccaggaaaaaaatacatcatgagataatttaactccaagaactttattgtaaaacttcagtggtgaatttcttttaaaaaaaatagatcttgaatcatagtggtgtattcttagcctcctttttttttcacttagacattttattatgagctttctctgtgttattgaacatttcaaagactttgcaaccaattaaatatgtgttggatggcttctgaaggaagacagtatgacaggcttgaagacagggttcttggcattgaaccagtgggagagacaggctcatgcatacataaccagaaatacaagtcgttcgaactgtcctaaatgttagaatgtaagcatgtactctgggtcatcaaaaccaatgacactcagggaaatccacccaggcctactttgggccttggacgatggaaaatatttg

SEQ ID NO: 381363 - DNA, 3063 bp, Homo sapiens
cacctagtccctggcacagactgaccccctgcccctctcttgcttccacaggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaatgaaaaat

SEQ ID NO: 381364 - DNA, 2275 bp, Homo sapiens
agaagggagcgagagcccctgagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccacttggcccaatttcccccaagaggcttctccaggaagtttcaaaggggcttccccttgggcctacccctcttccaagaaccagctttggcggggttggtcttgttcatgggccacacgaaccaagggaacttcctaagattccaaaccaggcaaggcacgggaagggacggagctggaagcaagtttcaggcaggccccccaggccggtgaaacgcaacgaagccccctcccatgatccttgggccaagggctcgggccaccaggcttgagcctttggccaggtttccacggcaggcgagtgttccacagcttttccgtcctccaaacaaccgtcaaggctgttacaagaaagggtgggtggagccatgggcggcaagggacaaaggggccctcggtaccttttgtggcgaggcctgggtgccagtgacttacccaggcatgtacaagccctggaagatgaattggcccgcggcccatgaacccatcccaagccactggggaggaaattgctttggcaaggggagcgaattttcggcacccagtcgatggaaccgccaggctttccaagaaagcttaacctagagtgtgcacgaaaacaacgcggagacgctctacagggcccctggtcgtgtaaaccccgcggcccttgggacttcccgtagtgagagagagctgcgaaaagcagactgtgtaagaggcccgtgcctgggcaccccgaagtggtacccgtg

SEQ ID NO: 381365 - DNA, 485 bp, Homo sapiens
ggaagccctatggggcggatgacttcctgcctgtgctcatgtatgtgctggcccgcagcaacctcacggagatgcttctcaatgtggagtacatgatggagctcatggaccccgccctgcagctgggggagggtgagtcaccaccccctgcccatcaggtgcattgcacacccccaactcagccacgccacgggcactctaggtggcccaacaagcacctcctggatgccagactctggctgagctctggacccatggatgcaaatgtgaatcctacacaggtcctgtcctgcaggagctcacagattagggggagagatgagccagtcaagagactgtgccacctccacgtaacaagtgctggaatagttggaatcccagaaggcataggagcatgttacccagactgtgcagtcagggaaggcttcctggaggaggtgacatctgagctgagcaatgaaggataaataggagccagctgatta

SEQ ID NO: 381366 - DNA, 1016 bp, Homo sapiens
tggtacaaaatagtatgtattttgtattctttaaaaaaaattgagcatttctaatctcttcattttccttaaccatttagaagtcaaaagttgaattatttgtgataagtgtatatgctctattaatatattattgctatagataagcatataataaagtttatatttattactaacatacatggaaattttgggctactgagatacctggcacagtcagtgactttgtctattcctacaggatctaattgaaaggtgttaggaaaggcatagcaaagagcctttttcctgttgttacaagcagtaaatggcccttaagaaacttcaaaaagaatgaatgcttgcttgagaaagaagggagtaagagaaaagcttttcagtaatgagcaggagaaaaaagaaaacctggtctgagagataaaagaggtgactattaaaacggaaggacacagtctaccagaaactcgtgaggctttacaaatcaaaatctagactcactttaccatggaaactgaagacaattagaaagtatatgtttacaattttgtaatattttactttatttttaattatccaaagcaaatataagactattcatgataggaattgatagtttggttatgactacaccgatattgaagccatgtgtaaatttgaaatacttaattttttaaagctgtttcatggaatctatagatgtgacaaaaagctaataatgtattctgtccactttacttccctgtcaccctaagactgtgtttctccttccagtaataggatacgaggtacttgtctgagaacatgtaactggagtagacttttatgtagtgatctgaggcccttactagatctctttctttctaagggaaatcaccaaattttgagcctataggtaaatcatttgtaaaccgggggttggctgggcgtggtggctcatgcctgtaatcccagcattttgggaggccgaggcaggcagatcacctgaggtcaggagttggaaaccaggctggcaaaca

SEQ ID NO: 381367 - DNA, 613 bp, Homo sapiens
aggccccagctcagcccatgccttttcagagcactgcctttccttgggcattagcagaccagtagaaatagaaacacacgtagtaaggaacacggctgtaggcagcaacagagacgtcatggaagatgcagacggaggctgtgggacccacatactctgcaccctcagccgagcctgtttctgaaaacaaacatgatctacttccttcaagccggaatccaggtgtgtcattaattttctgttaaacaaagagaatggtggctttttttgagtggagcacacctgtccccacttgtggagttgcagaatgtgggcactgccaggattccctctcagctctcacctctgtagaaatcacggcacaatacaaacaatggaaagctcctctattaaaatgtctgggtgccaccgcgaggcttgcagcagaacaattttggcctctctccagaggcaggtgtgaccggagccaacctgtctggagtgacttttttactatgaaactatcagcagcatggacgagtgaaacaatgttgcattatttggagcccctgggaatgtgcacaccccttataaatggactgtgtttacgctcctgtcccttcacagctgggat

SEQ ID NO: 381368 - DNA, 829 bp, Homo sapiens
atccttaattaaattaatccccccccccccggaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381369 - DNA, 606 bp, Homo sapiens
gcacaatttctcagctctgcagttctagtggaaaagcagttatagacactacataaacaaataagcgtgactgtagttttttgaccccttccctaaggtgctagaccttgtgctaagaacttctcatttaatgatgctgttttctccatgtgactgccctgtaagatagtagtattagaacagaaggtggttggtgttctcgtgcaggtcatacagctagtaagtggaggagatgggaagcaaaatcagttgtatgaatccagttcccatgtttcttctaccatcctgcctctctattaatgggttaatagttcactgagggtggtggcttatgcctgtaatcccagcattttgagaggctgaggcaggagtattgcttgaggccagttcaagaccagcatgggcaacataacaagatcctgtctctacagaagtaaaaaaaaaaaaaaaaaaattatctgggtgtggtagcaaatacttgtagcctccctcagccagaaggcttaggcaggaggatcacttgaacccaagagtttaaggttacagtgagctataattttaccacctcactccagcctggctgacagagggagaccctgtcacttt

SEQ ID NO: 381370 - DNA, 1948 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381371 - DNA, 1807 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 381372 - DNA, 2101 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtaagagtttttaaaaccttttcagcattattcgttcccattccccactccaaggtgagtggaatctccccccagatttgttgcctgaaattcaaggtttggagatccaggtctggtggccatgatgctctgggatcctaattctgcttctaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381373 - DNA, 1227 bp, Homo sapiens
tgttggccaggctggtttcgaactcctgacctcgagtgatctgcctgcctcagcctcccaaagtgttgggattacaggtgtgagtcaccgtgcccggccagcaatcagttctctttgtcaactttatttagttgcctgtgggaccctgacattctgtatctgtgctcctatggcctctggagatgtgtgtgaaaattgtctcctcggcccttagcctacttcacctcttgtgctcacaaaaaggggacagagaggagggagaggaatccagcaagatgaagccagcctgagagagcataaaaaccagtcattggtattgtggtcttgcccaaatctttccctcgtgtgaaggaagcctttgacagtgaagtttagaattaaatacagggccagctgaagcatggtgaagccctccaactgcctttgccttgcagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381374 - DNA, 1666 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcatgcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 381375 - DNA, 1807 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtacaacctgagaatcacaagcggtgtggtggtgtgtcagtgtggcctgtccatcccatctcatgcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381376 - DNA, 1380 bp, Homo sapiens
tgttggccaggctggtttcgaactcctgacctcgagtgatctgcctgcctcagcctcccaaagtgttgggattacaggtgtgagtcaccgtgcccggccagcaatcagttctctttgtcaactttatttagttgcctgtgggaccctgacattctgtatctgtgctcctatggcctctggagatgtgtgtgaaaattgtctcctcggcccttagcctacttcacctcttgtgctcacaaaaaggggacagagaggagggagaggaatccagcaagatgaagccagcctgagagagcataaaaaccagtcattggtattgtggtcttgcccaaatctttccctcgtgtgaaggaagcctttgacagtgaagtttagaattaaatacagggccagctgaagcatggtgaagccctccaactgcctttgccttgcagagcagtccatcatcagcgagtatgagaagagcttgcagtttgatgaaaagtgtctcagcatcatgctggctgagtgggaggcaaacccactcatctgtcctgtatgtacaaagtaagagtttttaaaaccttttcagcattattcgttcccattccccactccaaggtgagtggaatctccccccagatttgttgcctgaaattcaaggtttggagatccaggtctggtggccatgatgctctgggatcctaattctgcttctaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381377 - DNA, 1743 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381378 - DNA, 1512 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtaagagtttttaaaaccttttcagcattattcgttcccattccccactccaaggtgagtggaatctccccccagatttgttgcctgaaattcaaggtttggagatccaggtctggtggccatgatgctctgggatcctaattctgcttctaggtacaacctgagaatcacaagcggtgtggtggtgtgtcagtgtggcctgtccatcccatctcatgtgagtgttccacacacagatttcatga

SEQ ID NO: 381379 - DNA, 1848 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagaggtaacccctagtagtagtccttccttacctgtatttagctactggaatactgtgacctttcctccaatcaggattagtttataagtcccctttgtctacctccatcagtcaagtgtccaaaagactccttttgtactctgacatcttggctgtctagcttctcaataataagggtctccagggtgctagaccttgtgctaagaacttctcatttaatgatgctgttttctccatgtgactgccctgtaagatagtagtattagaacagaaggtggttggtgttctcgtgcaggtcatacagctagtaagtggaggagatgggaagcaaaatcagttgtatgaatccagttcccatgtttcttctaccatcctgcctctctattaatgggttaatagttcactgagggtggtggcttatgcctgtaatcccagcattttgagaggctgaggcaggagtattgcttgaggccagttcaagaccagcatgggcaacataacaagatcctgtctctacagaagtaaaaaaaaaaaaaaaaaaattatctgggtgtggtagcaaatacttgtagcctccctcagccagaaggcttaggcaggaggatcacttgaacccaagagtttaaggttacagtgagctataattttaccacctcactccagcctggctgacagagggagaccctgtcacttt

SEQ ID NO: 381380 - DNA, 1631 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381381 - DNA, 1743 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaatcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 381382 - DNA, 1836 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381383 - DNA, 1819 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgtgctttgcagtcagtggagaattgtccagaagacttggctcagctggaggagctgatagacatggctgtgctggaggaaattcaacaggagctgatcaaccaaggtacaacctgagaatcacaagcggtgtggtggtgtgtcagtgtggcctgtccatcccatctcattcttctgagttgacagagcagaagcttcgtgcctgtttagagggtagtataaatgagcacagtgcacattgtccccacacacctgaattttcagtcactggaggaacagaagaaaagtccagtcttctcatgagctgtctggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaacataaaaaaatttggtattttttcccccatgatattaggatgataatcatttcaaagcacatgtctagcttcagagtaggatttgttcactggccaaagcctgccatgaaactatggctttcagcatctgtctgctctactg

SEQ ID NO: 381384 - DNA, 1602 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagaacacaaaac

SEQ ID NO: 381385 - DNA, 1547 bp, Homo sapiens
ggcgggctcttcgccgccgccgctggggccccgaaggcgaacgactaagaaggagctgtcttctccgtcccacaggaaaagctctccgccgaggccaaagaccacgtttctcgtcagcaactgcggcggcggcgacgaaggcaacgacgaagaagctggtttctcagcttcggttggactctggtttttcagtccctcccggagccgcaagaacacgacgtggttaggaagccaggtctgccacagctcgccgtcgcccaccggtccctcggcggccgccatcttggcccaactgctcccctcactccagttgctcagcccgccgctgagcacagccaatccgcggccgtccactcactgtttcggccaatcaccgagcagacggcccggaagctcgagaggctcgtgccaggtcggggggcgaaggcgaggccagcccaccaagcaggggcgtcaccaagggaaagccaatcaccattatttctgaagcccaagggggcgggacgagaagtcaacagaatggtggtgctgctggaaatctagcacctggggagagcctgagacttgtgtatctaattgcttattggacacctccatctgggtaaacccaggcatccagaactttccctcaagacttacctccctcagtgcaggtcgggctggcctcacgcatttcgcttggatgcctaaatctgtctccacgtggggccggtcgataaaacaacacttcccagaatacgctgcgatccattcgcggtctgcacccggaaagtacacctcccaggggtctgtgcgcgcctccagggaacgggtcttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaagagcagtccatcatcagcgagtatgagaagagcttgcagtttgatgaaaagtgtctcagcatcatgctggctgagtgggaggcaaacccactcatctgtcctgtatgtacaaagtaagagtttttaaaaccttttcagcattattcgttcccattccccactccaaggtgagtggaatctccccccagatttgttgcctgaaattcaaggtttggagatccaggtcctcgagcccccacctctgccgaccctctgctctagctacaccctccccaccacagctccctcatgccgcccctcccctccccccaccccccccttccatgccacccaccccgcccccccaccagccacccccttctccctccctcccctgccggaccccgccctccg

SEQ ID NO: 381386 - DNA, 521 bp, Homo sapiens
aaagttcattacaggaagtaatgaaggtatccaggagtagcacagatgaattatcacatcgtgaacacacccatgtagccagcaccatgcccagctagtttttgtattttcagtagagacgggattacaccatgttggccaggatggtctcgagctcctgacctcgtgatccgcccgccttggcatcccaaagtgctgggattataggcgtgacacacacgcctaagtaagttgtaaacataagttgttcagccgcatctcccaaagccagtaaattctcctatatagctgcaatcatcacactttaagacagtgaacactaattgcacaaaatctaacccagttcatgttcagatttcccctgagggaactccagggatggtttcggggatgagggaagatacttaggtttcaggtttcccagggttcctaggaacatcagcccacccttccaattttacagaagagacagatccacagagcagaacagcctccccaagccacagagttggtgacccagc

SEQ ID NO: 381387 - DNA, 3124 bp, Homo sapiens
gaagctccacaccagccattacaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagaacagtgtccgggacatcacgggtgccctgttcaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttgggaggccggggttggaggatcatttgagcccaggaattggaaagcagcctggccaacatagtgggaccctgtctctacaaaaaaaaaatttgccaagagcctgagtgacagagcaagaccccatctcaaaaaaaaaacaaacaaacaaaaaaaaaaccatatatatacatatatatatagcagctttatggagatataattcttatgccatataattcaccttcttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcggcctcccaagtagctgagactacaggcacacaccaccacgcctggctaatttttgtatttttggtagagacgggtttcaccatgttggtcagactagtctcaaactcctgacctcaagtgatctgcccgcctcgacctctctcaaaatgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatg

SEQ ID NO: 381388 - DNA, 2004 bp, Homo sapiens
gagtgcagtgagctgagatcgcaccactgtactccagcctgggtgataggagccggagggtgtctcaaaaaaaaaaaaagaaagaactttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttgggaggccggggttggaggatcatttgagcccaggaattggaaagcagcctggccaacatagtgggaccctgtctctacaaaaaaaaaatttgccaagagcctgagtgacagagcaagaccccatctcaaaaaaaaaacaaacaaacaaaaaaaaaaccatatatatacatatatatatagcagctttatggagatataattcttatgccatataattcaccttcttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcggcctcccaagtagctgagactacaggcacacaccaccacgcctggctaatttttgtatttttggtagagacgggtttcaccatgttggtcagactagtctcaaactcctgacctcaagtgatctgcccgcctcgacctctctcaaaatgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatg

SEQ ID NO: 381389 - DNA, 621 bp, Homo sapiens
acttaagctataaaatagaggctatagtaataatctccacctgtttcatagctcaagaaatagcatctttatttagcggtgcctacatcttttatgtttaaaattccttaagacaagacatctgtacacaatgtagctatagtgtgatttacaataactttgtgtttttgttatcagcaagagatcacttacaaagagacaatacaccctttgtacttgctagtaaaacactacatagttttacatgtcaagcatatgtaaggcatggtggaagtcaggaaggataaattcattacatgcctgtcatcacatcagaaatccacctcaatcagaagtggtgtgggagttgaaacatatctgccactcaggtgatatattaatcagatttgccctttgaattgtacagtaagagctgtaatggcattacatatttatggccaaaattggctcattagtggatagctttgatttggaggttaaaaaaaaaaaatctaactatgttttattttccaaacccagttttactaacatgttgtagcttctcataaaatattttgaactagtaacattaagttttgacaaaagcttgtaacctgaggggaaaaaaaattggtcagatac

SEQ ID NO: 381390 - DNA, 437 bp, Homo sapiens
tctgagacagggtctcactctattgtctgggccagagtgcagtggtgtgattatgcctcactgcagtccttgacctcctgggctcaggggatccccccacctcagcctcccaagtagctgggactaaaggcatgcaccaatcatgcccagccaattttttaattttttgtagagatgggggtctcactatattgcccaggctggtctcaaattcctgggcccaagttatcctccaatctcagtctcccaaagtattggaattacgggcctgtgagccatggcgcccagcctgctcactgctcttaaagcatcaagttgcagatgcttatttcagctgtcactcacatctacatgtgtgattattccatgaaagttaatttcccctctagtctagactattgctctttgagaacatcagccacgtctgcctttgcttt

SEQ ID NO: 381391 - DNA, 379 bp, Homo sapiens
agacaaaaagagggctgaactattttgtttttattcacactgtcatgaaatccatttaggagttgaggtcagcattagaaaagcgttattaatgaatctggatagaggatttaaaagcattcaaaatcaaaactaaaataaactaatatcatatttatataacaccaaggcactctaagcatgaaaagcttatggttaactacatgatatctgtatacttcttctccaaactaattgagttacatgcttacaagagtcaatttgcatttgtactccaaagtatttatgcctattatacttatagaatatatttaaatatgtaaactaatgaaatacaaatagaaagttattttctataaaaactaaattgataaacatg

SEQ ID NO: 381392 - DNA, 354 bp, Homo sapiens
cagagaagcaacgtagctttctgatagaaacagaggcaagggtagaacccaggtctcctgtccctaaacaactatcctttgtttcagttccagcatacgttcatattctttgcctgatcatatgtttacacaagcttgtatattactgtcattttctaaaataacaaaccttacatttttattgcttttaatcaatctgttttatttttttctattttcctacacatctaaaatcttgataataatcctgtttaatcattaggatgataataaaaataaaataatagcagtcccttatgaagtacaattattgcattctaatagatttacagggtgaatattatagtcctgatt

SEQ ID NO: 381393 - DNA, 234 bp, Homo sapiens
  misc_feature (39)..(39): n is a, c, g, or t
cttccctgcatcaaccacattgtgtgataatactatttncttataattttagtgtaaatacttataaattttaagatgcacaccttacttctgaagcttcaagagctctagaaagaaactgtttatcctcattttacagaaggaatgtgtttcacaagaagttacatatctagaaaggattatggctagaattcaaacccacatttttaatcccatataactacagaaaataca

SEQ ID NO: 381394 - DNA, 488 bp, Homo sapiens
cagaacctacatgtgtcatttcactgctttaaaacctcttgcctcctacatgcctacagagaccctttgtaaatagtctctgagatccttcctttaacccattccccttccctgcacatacaaacgctgcttctctttactccctggactgcaggcctcttgataaatttgagtctctgaacacactgttctttctgtttggaatgtcctttcacccccattttgttgcccagaaaattcctactcatctataagccccgttcacgtggcaccttttttgatgaggcatccctagttcccctgtcccattttcttatagcatctagtagacctctgtgttctcacactcatcctcagtaccacggttgtcccctgaaaggtgttgtgtccctcaccagactgggagcacctcaagggcagaacccatgtcatgttcctttttgtatttccagacctgaaactgccagtaaataaaccctaaaagtaga

SEQ ID NO: 381395 - DNA, 509 bp, Homo sapiens
cagaacctacatgtgtcatttcactgctttaaaacctcttgcctcctacatgcctacagagaccctttgtaaatagtctctgagatccttcctttaacccattccccttccctgcacatacaaacgctgcttctctttactccctggactgcaggcctcttgataaatttgagtctctgaacacactgttctttctgtttggaatgtcctttcacccccattttgttgcccagaaaattcctactcatctataagccccgttcacgtggcaccttttttgatgaggcatccctagttcccctgtcccattttcttatagcatctagtagacctctgtgttctcacactcatcctcagtaccacggttgtcccctgaaaggtgttgtgtccctcaccagactgggagcacctcaagggcagaacccatgtcatgttcctttttgtatttccagactgtgaaagaacagtgtgttcagacactcaaatttatcaagaggcctgcagtcgac

SEQ ID NO: 381396 - DNA, 488 bp, Homo sapiens
gggaatatatattcctccctcaaaggactgtgaggattagacacaactgagatgacacacgagaagtgtagggcacaaagtcggtattcagaagatgatttttaaaatatcaccacttcattcctgcataaggaatgctgttggtggtgatattgccattcctgtgaggcactgaggaaaagctctcttaggagataagggctgtagtagttggaagaattacaggcttccttaattccagaggcctcagtgcccttcagaggatatcattcatatgaagaggtctgtatttaaaaattggagatagcagatcatctgtgatccattctcatgagtgcagagaagcactttcatagattcttgtttcttcctctgtgtgtgtgtgtgtgtgtgtgtgtgtatgtatgtgtgcaccgagcacctgtgcttgtgcttgaattcctcctggtgtttccccctggaaagttccttaaaaattgttagttaaa

SEQ ID NO: 381397 - DNA, 293 bp, Homo sapiens
tgaagcacagagcttacatatcttatatcatccacactcaacacatgctactgtagttgtctgataatgggtctctgtcttcctatgactgggctccttgacctcagaggtgagtctaactcagcttggtgtctccatcacccccagcatagggccagctccatcactggcaccagataaccaccttctgagggagtagatggaagatgattcagcagatagttctgaaagtctgtggctctttatgtgtcttgactggatatgtgggtttcttgctgcatgtatagtggaag

SEQ ID NO: 381398 - DNA, 1506 bp, Homo sapiens
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagattccagagtcagtgtcacaaaaccatttatgttaccccctgttgcagccagctcccttaggaatgacagcagtagcagtaataggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtg

SEQ ID NO: 381399 - DNA, 1422 bp, Homo sapiens
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggctggtaacagttcatgtttgcttcataaatgaagcagctttaaacaaattcatattctgtctggagtgacagaccacatctttatctgttcttgctacccatgactttatatggatgattcagaaattggaacagaatgttttactgtgaaactggcactgaattaatcatctataaagaagaacttgcatggagcaggactctattttaaggactgcgggacttgggtctcatttagaacttgcagctgatgttggaagagaaagcacgtgtctcagactgcatgtaccatttgcatggctccagaaatgtctaaatgctgaaaaaacacctagctttattcttcagatacaaactgcagcctgtagttatcctggtctctgcaagtagatttcagcttggatagtgagggtaacaatttttctcaaagggatctggaaaaaatgtttaaaactcagtagtg

SEQ ID NO: 381400 - DNA, 617 bp, Homo sapiens
  misc_feature (28)..(28): n is a, c, g, or t
  misc_feature (587)..(587): n is a, c, g, or t
ctactactactaaattcgcggccgcgtngacgttgccttctctcatgtcatgcctgtatgtatacacagacacatatgaaatgcatataggcatgcttggtatgtgtatatgcatatacagagaaagaaatgttttaactacttggaaagactaccttaagacaaatgaagtcttccctcttccctatagtaataagaaggtaggctccccattcaattttgcaatcttctgctactatatttacagaaaagctgccttttacaatgccgagatcatggtgtacctcagaatctctgaccaagagcaaataagcattttttcttattgtttttcagtatgttgcaagagaaagagagagagtttcaagaagtgtaattgtggcttgtatcaacactgttactttcgtacattggtaagtttttttcttctttcctttttttttcttttttttattatactttaagttctagggtacatgtgcacaatgtgcaggtttgttacgtatgtttacatgtgccgtgttggtgtgctgcacccattaactcgtcatttacattaggtatatctcctaatgctatcccttgtngacgcggccgcgaatttagtagtagtaggc

SEQ ID NO: 381401 - DNA, 1002 bp, Homo sapiens
  misc_feature (1002)..(1002): n is a, c, g, or t
ccgcctcgcgccgagactagaagcgctgcgggaagcagggacagtggagagggcgctgcgctcgggctacccaatgcgtggactatctgccgccgctgttcgtgcaatatgctggagctccagaacagctaaacggagtcgccacaccactgtttgtgctggatcgcagcgctgcctttccttatgaagaagacacaaacttggattctcacttgcatttatcttcagctgctcctatttaatcctctcgtcaaaactgaagggatctgcaggaatcgtgtgactaataatgtaaaagacgtcactaaattggtggcaaatcttccaaaagactacatgataaccctcaaatatgtccccgggatggatgttttgccaagtcattgttggataagcgagatggtagtacaattgtcagacagcttgactgatcttctggacaagttttcaaatatttctgaaggcttgagtaattattccatcatagacaaacttgtgaatatagtcgatgaccttgtggagtgcgtcaaagaaaactcatctaaggatctaaaaaaatcattcaagagcccagaacccaggctctttactcctgaagaattctttagaatttttaatagatccattgatgccttcaaggactttgtagtggcatctgaaactagtgattgtgtggtttcttcaacattaagtcctgagaaagggaaggccaaaaatccccctggagactccagcctacactgggcagccatggcattgccagcattgttttctcttataattggctttgcttttggagccttatactggaagaagagacagccaagtcttacaagggcagttgaaaatatacaaattaatgaagaggataatgagataagtatgttgcaagagaaagagagagagtttcaagaagtgtaattgtggcttgtatcaacactgttactttcgtacattggaggctgaggcaggagaatcgcttgaacctggcgctgagtgcan

SEQ ID NO: 381402 - DNA, 432 bp, Homo sapiens
catactgaaagggtgggtgtggtactggtcacatggcatagagcctttaactcagcttttaagtgttttgtttgcttgaacatgcactttgaaaggacctcacaaaactggttctccatgacaatgtgtggttacctgctaactctggctatggacagatgagaaacatacatggtcaaaagtcaacctttgtttaaagtttctaagattaaaaataaacccctgccagccctgggagtctctgtaaggctaaacacaccctcccttgatagcagggtgttctcagatttctgcagtaataattatgccaggccagttgtggtggctcatgcctataatcccaacacttcgagaggctgacatgggaggatcacgtgaggctaggagtttgagatcagcctgggcaacacagcaggaccctgtctcttttta

SEQ ID NO: 381403 - DNA, 3435 bp, Homo sapiens
gaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccttttgtgtttttttttttttttttttgaagtcttgtataactaacagcatccccaaaacaaaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatataatatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttgtttacacagcttgtggaattatttcgtgggaaaataaatttttataacttctcccacttcaatttctaacc

SEQ ID NO: 381404 - DNA, 384 bp, Homo sapiens
catgtacacagaaggggaaccttgaagacattatctccatgcctcaaccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccctgtctctactaaaaagataaaaaattagccaggtgtggtggtgcacacctgcaatcccagctacttgggag

SEQ ID NO: 381405 - DNA, 712 bp, Homo sapiens
ccacttgcgtttgttaattgactttgatgagctcctctgctctgcctaagtggttctggaacagagagctgttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctggggtaagcatacgggagagaagccggccagatgcacggtgcggtttaaagaaaacaggaatgcatagaactgttgccgagcttgagctaaaatcatactagttacttaactttttagactttcttatcttgccagaaatgttgccattcacagtgttattactttaatgctgtggtgatttaagcaagtgaaactgtaactctggttttaaactgtatgttactgagcttcatttagtagcttagggagagagtcccggtgcagacaaatttagtggaaaatgaaaatgctttttccagctatagaccagcacttgtcttgagtatcactctgacagcctagccactgacttcttgtgtgtctgagacctatctgtgtaaatcaggatggtctgacttgctg

SEQ ID NO: 381406 - DNA, 737 bp, Homo sapiens
atttataaaactgtttgcacaaaggtaaattgtcctgtgacatgaaatatttaaggtacacttcaatatttatctctttctctcaataattccaattggtctgattatataaggggaagatttctgtaacagtacttcctaaagatctcttggtaggatgggctgttattctttgaacccagagagcttatccctactcatggtgacagcagctgctgcaagggaattcagcctggtcctacggcagcaccaggacagacaaggaacgcagagcctttgatagattgctgaggacgctaaatgcatttcttacatgtgaaacccatgagccgaagggtttcttgaatgataatatttaaggcatagttaatggtcattgccatatttctctaatgcttttgattttgtgtttagaaatttaacaatgactggtggatagggcgattggtaaaagaaggctgtgaaatcggattcattccaagcccagtcaaactagaaaacatgaggctgcagcatgaacagagagccaagcaagggaaattctactccaggtatgagacagatgtcaagtgtttgcataaaacttagattataccactatctgtgtactgttgtctgctgtattctgtatcctttattatgtattaacaaggaggctggtaatatggtttattgatagcatcacaaatcttgcattttcctgcatttaaaaaacttcagtccagcacctgattttc

SEQ ID NO: 381407 - DNA, 684 bp, Homo sapiens
gggaagagaatgtttagggttatgagatgcattaagtttagaacgagttgatgctcggcttttgaatgcacttgtcttctttatttttaaagcaatataaagcactcgagtgtgtgttttcagcccctcctggaatgggaaaataagaatctccctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctcatgaaggccacctggatcaggcttctgaaaagagccaagggaggaaggctgaagaattctgatatctgtggttcggcagactcctacactagccgtccatccgattccgatgtatctctggaggaggaccgggaggcagtgcgcagagaagcggagcggcaggcccaggcacagttggaaaaagcaaaggtaaaatcgtttcctccctgccaagatctttgcaagttgtgctgtgcccctgatagaccacctgtgggagtttcccctaaaggttgtttgatctattagagaatttcattgtctggttttagaaaggtacaaaaaatggagcctagtttcttcccttggtagaaa
